United States Patent
Baca et al.

(10) Patent No.: US 12,195,524 B2
(45) Date of Patent: Jan. 14, 2025

(54) MULTI-SPECIFIC ANTIGEN BINDING MOLECULES TARGETING HIV AND METHODS OF USE

(71) Applicant: Gilead Sciences, Inc., Foster City, CA (US)

(72) Inventors: Manuel Baca, Lexington, MA (US); Brian A. Carr, Foster City, CA (US); Sheila B. Clancy, Pacifica, CA (US); Craig S. Pace, Pacifica, CA (US); Heather T. Stephenson, San Jose, CA (US); Nathan D. Thomsen, Castro Valley, CA (US)

(73) Assignee: Gilead Sciences, Inc., Foster City, CA (US)

( * ) Notice: Subject to any disclaimer, the term of this patent is extended or adjusted under 35 U.S.C. 154(b) by 0 days.

(21) Appl. No.: 17/409,260

(22) Filed: Aug. 23, 2021

(65) Prior Publication Data
US 2023/0056252 A1    Feb. 23, 2023

Related U.S. Application Data

(60) Provisional application No. 63/163,713, filed on Mar. 19, 2021, provisional application No. 63/070,141, filed on Aug. 25, 2020.

(51) Int. Cl.
| | | |
|---|---|---|
| *C07K 16/10* | (2006.01) | |
| *A61P 31/18* | (2006.01) | |
| *C07K 16/28* | (2006.01) | |
| *A61K 39/00* | (2006.01) | |

(52) U.S. Cl.
CPC .......... *C07K 16/1063* (2013.01); *A61P 31/18* (2018.01); *C07K 16/2809* (2013.01); *A61K 2039/505* (2013.01); *C07K 2317/24* (2013.01); *C07K 2317/31* (2013.01); *C07K 2317/55* (2013.01); *C07K 2317/622* (2013.01); *C07K 2317/92* (2013.01); *C07K 2317/94* (2013.01)

(58) Field of Classification Search
CPC .......................... C07K 16/1063; C07K 2317/31
See application file for complete search history.

(56) References Cited

U.S. PATENT DOCUMENTS

| | | | |
|---|---|---|---|
| 5,624,821 A | 4/1997 | Winter et al. | |
| 5,648,260 A | 7/1997 | Winter et al. | |
| 6,491,916 B1 | 12/2002 | Bluestone et al. | |
| 8,088,376 B2 | 1/2012 | Chamberlain et al. | |
| 8,394,925 B2 | 3/2013 | Chamberlain et al. | |
| 8,475,792 B2 | 7/2013 | Dall'Acqua et al. | |
| 8,546,543 B2 | 10/2013 | Lazar | |
| 8,846,042 B2 | 9/2014 | Zhou | |
| 8,911,728 B2 | 12/2014 | Dimitrov et al. | |
| 9,587,021 B2 | 3/2017 | Huang et al. | |
| 9,701,759 B2 | 7/2017 | Desjarlais et al. | |
| 9,803,023 B2 | 10/2017 | Chamberlain et al. | |
| 9,969,809 B2 | 5/2018 | Kuo et al. | |
| 10,066,016 B2 | 9/2018 | Dubridge et al. | |
| 10,131,710 B2 | 11/2018 | Moore et al. | |
| 10,155,815 B2 | 12/2018 | Bacac et al. | |
| 10,294,300 B2 | 5/2019 | Raum et al. | |
| 10,882,907 B2 | 1/2021 | Rehder et al. | |
| 11,597,759 B2 | 3/2023 | Cihlar et al. | |
| 2014/0302064 A1 | 10/2014 | Moore | |
| 2015/0361160 A1 | 12/2015 | Burton et al. | |
| 2020/0317779 A1 | 10/2020 | Kim et al. | |

FOREIGN PATENT DOCUMENTS

| | | |
|---|---|---|
| EP | 0505908 A1 | 9/1992 |
| JP | H05-219960 A | 8/1993 |
| WO | WO-94/04690 A1 | 3/1994 |
| WO | WO-2011/146891 A2 | 11/2011 |
| WO | WO-2013/163427 A1 | 10/2013 |
| WO | WO-2014/110601 A1 | 7/2014 |
| WO | WO-2014/159940 A1 | 10/2014 |
| WO | WO-2015/001085 A1 | 1/2015 |
| WO | WO-2015/063339 A1 | 5/2015 |
| WO | WO-2015/103549 A1 | 7/2015 |
| WO | WO-2016/014974 A2 | 1/2016 |
| WO | WO-2016/054023 A1 | 4/2016 |
| WO | WO-2016/054053 A2 | 4/2016 |
| WO | WO-2016/071004 A1 | 5/2016 |
| WO | WO-2016/153572 A1 | 9/2016 |
| WO | WO-2016/168758 A1 | 10/2016 |
| WO | WO-2017/074878 A1 | 5/2017 |
| WO | WO-2017/079272 A2 | 5/2017 |
| WO | WO-2017/106346 A2 | 6/2017 |
| WO | WO-2017/136659 A2 | 8/2017 |
| WO | WO-2017/157305 A1 | 9/2017 |
| WO | WO-2018/183139 A1 | 10/2018 |

(Continued)

OTHER PUBLICATIONS

Dondelinger, M., et al., Oct. 2018, Understanding the Significance and Implications of Antibody Numbering and Antigen-Binding Surface/Residue Definition, Front. Immunol. 9(Article 2278), pp. 1-15.*

Sela-Culang, I., et al., Oct. 2013, The structural basis of antibody-antigen recognition, Front. Immunol. 4(Article 302), pp. 1-13.*

Chen W et al. (2014), "Exceptionally Potent and Broadly Cross-Reactive, Bispecific Multivalent HIV-1 Inhibitors Based on Single Human CD4 and Antibody Domains", Journal of Virology, vol. 88, No. 2, p. 1125-1139.

Chen W et al. (2016), "Improving the CH1-CK heterodimerization and pharmacokinetics of 4Dm2m, a novel potent CD4-antibody fusion protein against HIV-1", MABS, vol. 8, No. 4, p. 761-774.

Intl. Preliminary Report on Patentability—Written Opinion dated Mar. 9, 2023 for Intl. Appl. No. PCT/US2021/047165, 10 pages.

Intl. Search Report-Written Opinion dated Dec. 23, 2021 for Intl. Appl. No. PCT/US2021/047165, 18 pages.

(Continued)

*Primary Examiner* — Jeffrey S Parkin

(57) ABSTRACT

Provided are multi-specific antigen binding molecules, including bispecific antibodies, that bind to CD3 and an HIV antigen, including HIV envelope protein gp120. Also provided are methods of using such antigen binding molecules to treat or prevent HIV infection.

21 Claims, 47 Drawing Sheets

Specification includes a Sequence Listing.

(56) References Cited

FOREIGN PATENT DOCUMENTS

| WO | WO-2018/191438 A1 | 10/2018 |
|----|-------------------|---------|
| WO | WO-2018/237148 A1 | 12/2018 |
| WO | WO-2019/034580 A1 | 2/2019 |
| WO | WO-2019/143636 A1 | 7/2019 |
| WO | WO-2019/183387 A1 | 9/2019 |
| WO | 2020047176        | 3/2020  |

OTHER PUBLICATIONS

Petrovas C et al. (2017), "Follicular CD8 T cells accumulate in HIV infection and can kill infected cells in vitro via bispecific antibodies", Science Translational Medicine, vol. 9, No. 373, pp. 1-14.

Sloan D D et al. (2015), "Targeting HIV Reservoir in Infected CD4 T Cells by Dual-Affinity Re-targeting Molecules (DARTs) that Bind HIV Envelope and Recruit Cytotoxic T Cells", PLOS Pathogens, vol. 11, No. 11, pp. 1-29.

Walker L M et al. (2011), "Broad neutralization coverage of HIV by multiple highly potent antibodies", Nature, vol. 477, No. 7365, pp. 466-470.

Wu G et al. (2017), "HDAC inhibition induces HIV-1 protein and enables immune-based clearance following latency reversal", JCI Insight, vol. 2, No. 16, pp. 1-11.

Office Action and Search Report dated May 30, 2023 for Taiwanese Appl. No. 110131303.

Examination Report dated Nov. 7, 2023 for European Appl. No. 21770379.2.

Pessano S et al. (1985), "The T3/T cell receptor complex: antigenic distinction between the two 20-kd T3 (T3-δ and T3-ε) subunits", The EMBO Journal, vol. 4, No. 2, pp. 337-344.

Traunecker A et al. (1991), "Bispecific single chain molecules (Janusins) target cytotoxic lymphocytes on HIV infected cells", The EMBO Journal, vol. 10, No. 12, pp. 3655-3659.

Brozy J et al. (2018), "Antiviral Activity of HIV gp120-Targeting Bispecific T Cell Engager Antibody Constructs", Journal of Virology, vol. 92, Issue 14, e00491-18, pp. 1-13.

Li W et al. (2017), "One-domain CD4 Fused to Human Anti-CD16 Antibody Domain Mediates Effective Killing of HIV-1-Infected Cells", Scientific Reports, vol. 7, 9130, pp. 1-12.

Office Action dated Mar. 1, 2024 for Japanese Appl. No. 2023-513114.

Notice of Allowance dated Jan. 29, 2024 for Taiwanese Appl. No. 110131303.

Examination Report dated Apr. 16, 2024 for European Appl. No. 21770379.2.

Office Action dated Apr. 23, 2024 for Egyptian Appl. No. 275/2023.

Capon D J et al. (1989), "Designing CD4 immunoadhesins for AIDS therapy", Nature, 337(6207):525-31.

Chamow S M et al. (1992), "CD4 immunoadhesins in anti-HIV therapy: new developments", Int J Cancer Suppl., 7:69-72.

Nordstrom J L et al. (2022), "Bispecific antibody-derived molecules to target persistent HIV infection", J Virus Erad., 8(3):100083.

Office Action dated Jun. 28, 2024 for Eurosian Appl. No. 202390595.

Office Action and Search Report dated Aug. 8, 2024 fro Chilean Appl. No. 2023-00539.

\* cited by examiner

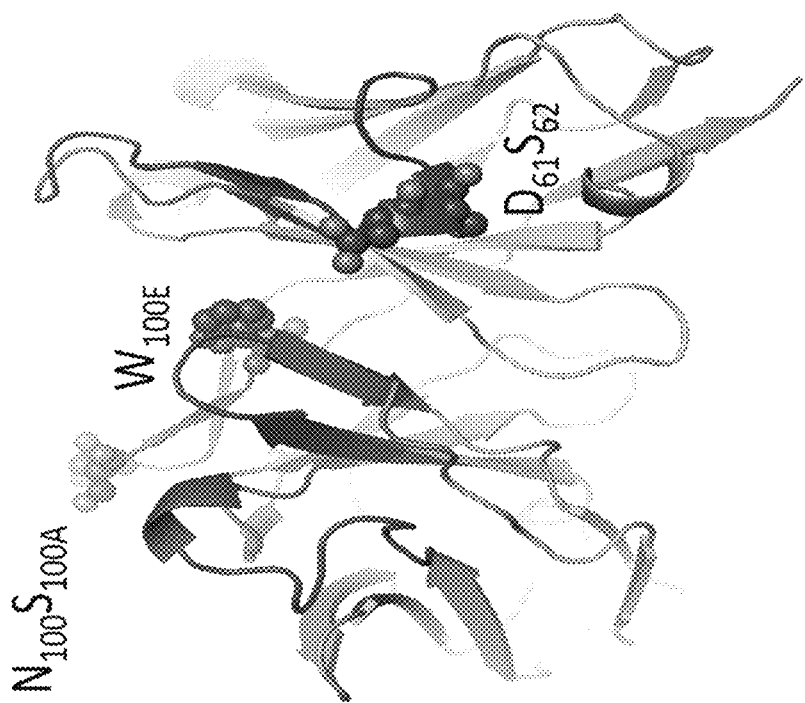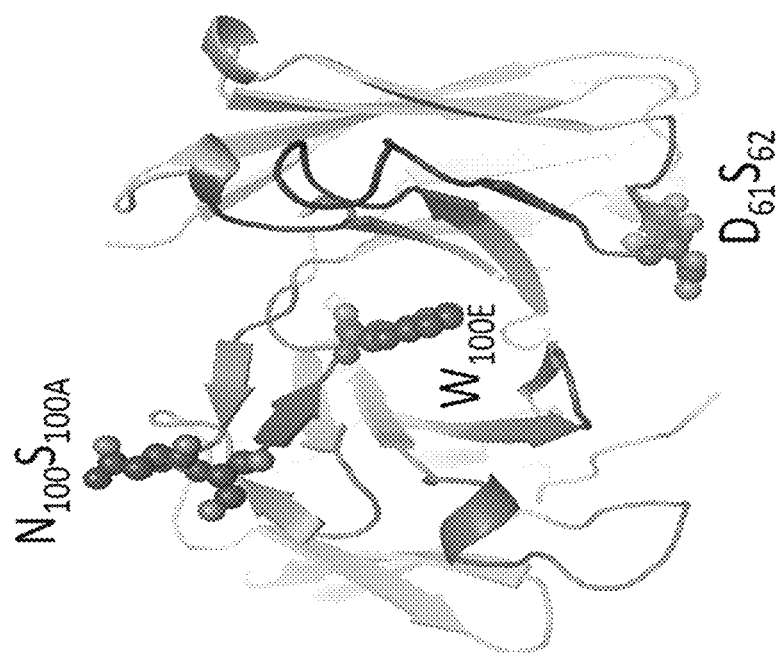
Fig. 1

```
mSP34_VH       EVKLLESGGGLVQPKGSLKLSCAASGFTFNTYAMNWVRQAPGKGLEWVARIRSKYNNYATYY
Comparator1_VH EVQLVESGGGLVQPGGSLRLSCAASGFTFSTYAMNWVRQAPGKGLEWVARIRSKYNNYATYY
Comparator2_VH EVKLVESGGGLVQPGGSLRLSCAASGFTFNTYALNWVRQAPGKGLEWVARIRSKYNNYATYY
Comparator3_VH EVQLVESGGGLVQPGGSLRLSCAASGFTFNTYAMNWVRQAPGKGLEWVGRIRSKYNNYATYY
Comparator4_VH EVQLLESGGGLVQPGGSLRLSCAASGFTFSTYAMNWVRQAPGKGLEWVSRIRSKYNNYATYY
Comparator5_VH EVQLVESGGGLVQPGGSLRLSCAASGFTFSTYAMNWVRQAPGKGLEWVGRIRSKYNNYATYY mSP34_VH       ADSVKDRFTISRDDSQSILYLQMNNLKTEDTAMYYCVRHGNFGNSYVSWFAYWGQGTLVTVSA
Comparator1_VH ADSVKDRFTISRDDSKNSLYLQMNSLKTEDTAVYYCVRHGNFGNSYVSWFAYWGQGTLVTVSS
Comparator2_VH ADSVKDRFTISRDDSKSSLYLQMNNLKTEDTAVYYCVRHGNFGNSYVSWFAYWGQGTLVTVSS
Comparator3_VH AASVKGRFTISRDDSKNSLYLQMNSLKTEDTAVYYCARHGNFGNSYVSWFAYWGQGTLVTVSS
Comparator4_VH ADSVKGRFTISRDDSKNTLYLQMNSLRAEDTAVYYCVRHGNFGNSYVSWFAYWGQGTLVTVSS
Comparator5_VH ADSVKGRFTISRDDSKNTLYLQMNSLRAEDTAVYYCVRHGNFGDSYVSWFAYWGQGTLVTVSS
```

*Fig. 2A*

| | |
|---|---|
| mSP34_VL | QAVVTQESALTTSPGETVTLTCRSSTGAVTTSNYANWVQEKPDHLFTGLIGGTNKRAPG |
| Comparator1_VL | QAVVTQEPSLTVSPGGTVTLTCRSSTGAVTTSNYANWVQQKPGQAKPGQAPRGLIGGTNKRAPW |
| Comparator2_VL | QAVVTQEPSFSVSPGGTVTLTCRSSTGAVTTSNYANWVQQTPGQAFRGLIGGTNKRAPG |
| Comparator3_VL | QTVVTQEPSLTVSPGGTVTLTCRSSTGAVTTSNYANWVQQKPGQAPRGLIGGTNKRAPG |
| Comparator4_VL | QAVVTQEPSLTVSPGGTVTLTCGSSTGAVTTSNYANWVQEKPGQAPRGLIGGTNKRAPG |
| Comparator5_VL | QAVVTQEPSLTVSPGGTVTLTCGSSTGAVTTSNYANWVQQKPGKSPRGLIGGTNKRAPG |
| | |
| mSP34_VL | VPARFSGSLLGDKAALTITGAQTEDEAIYFCALWYSNLWVFGGGTKLTVL |
| Comparator1_VL | TPARFSGSLLGGKAALTITGAQAEDEADYYCALWYSNLWVFGGGTKLTVL |
| Comparator2_VL | VPARFSGSLLIGDKAALTITGAQADDESIYFCALWYSNLWVFGGGTKLTVL |
| Comparator3_VL | TPARFSGSLLGGKAALTLSGVQPEDEAEYYCALWYSNLWVFGGGTKLTVL |
| Comparator4_VL | TPARFSGSLLGGKAALTLSGAQPEDEAEYYCALWYSNLWVFGGGTKLTVL |
| Comparator5_VL | VPARFSGSLLGGKAALTISGAQPEDEADYYCALWYSNHWVFGGGTKLTVL |

*Fig. 2B*

```
mSP34         EVKLLESGGGLVQPKGSLKLSCAASGFTFNTYAMNWVRQAPGKGLEWVARIRSKYNNYATYYA
IGHV3-72_IGHJ6 EVQLVESGGGLVQPGGSLRLSCAASGFTFSDHYMDWVRQAPGKGLEWVGRTRNKANSYTTEYA
huSP34_HC1    EVQLVESGGGLVQPGGSLRLSCAASGFTFNTYAMNWVRQAPGKGLEWVGRIRSKYNNYATYYA
huSP34_HC2    EVQLVESGGGLVQPGGSLRLSCAASGFTFSTYAMNWVRQAPGKGLEWVGRIRSKYNNYATYYA
huSP34_HC3    EVQLVESGGGLVQPGGSLRLSCAASGFTFNTYAMNWVRQAPGKGLEWVGRIRSKYNNYATYYA
huSP34_HC4    EVQLVESGGGLVQPGGSLRLSCAASGFTFSTYAMNWVRQAPGKGLEWVGRIRSKYNNYATYYA
huSP34_HC5    EVQLVESGGGLVQPGGSLRLSCAASGFTFSTYAMNWVRQAPGKGLEWVGRIRSKYNNYATYYA
huSP34_HC6    EVQLVESGGGLVQPGGSLRLSCAASGFTFSDYAMNWVRQAPGKGLEWVGRIRSKYNNYATYYA
huSP34_HC7    EVQLVESGGGLVQPGGSLRLSCAASGFTFSDYAMNWVRQAPGKGLEWVGRTRSKYNNYATYYA
huSP34_HC8    EVQLVESGGGLVQPGGSLRLSCAASGFTFSDYAMNWVRQAPGKGLEWVGRTRSKYNNYATYYA
huSP34_HC9    EVQLVESGGGLVQPGGSLRLSCAASGFTFSDYAMNWVRQAPGKGLEWVGRTRSKYNSYATYYA
huSP34_HC10   EVQLVESGGGLVQPGGSLRLSCAASGFTFSDYAMNWVRQAPGKGLEWVGRTRSKYNSYATYYA mSP34         DSVKDRFTISRDDSQSILYLQMNNLKTEDTAMYYCVRHGNFGNSYVSWFAY------YFDYWGQGTLVTVSA
IGHV3-72_IGHJ6 ASVKGRFTISRDDSKNSLYLQMNSLKTEDTAMYYCVRHGNFGNSYVSWFAY------YFDYWGQGTLVTVSS
huSP34_HC1    ASVKGRFTISRDDSKNSLYLQMNSLKTEDTAMYYCVRHGNFGNSYVSWFAVWGQGTLVTVSS
huSP34_HC2    ASVKGRFTISRDDSKNSLYLQMNSLRTEDTAVYYCVRHGNFGHSYVSWFAVWGQGTLVTVSS
huSP34_HC3    DSVKGRFTISRDNSKNTLYLQMNSLRTEDTAVYYCVRHGNFGHSYVSWFAVWGQGTLVTVSS
huSP34_HC4    ASVKGRFTISRDDSKNSLYLQMNSLRAEDTAMYYCVRHGNFGNSYVSWFAVWGQGTLVTVSS
huSP34_HC5    DSVKGRFTISRDDSKNSLYLQMNSLRAEDTAVYYCVRHGNFGHSYVSWFAVWGQGTLVTVSS
huSP34_HC6    DSVKGRFTISRDNSKNTLYLQMNSLRAEDTAMYYCVRHGNFGNSYVSWFAVWGQGTLVTVSS
huSP34_HC7    ASVKGRFTISRDDSKNSLYLQMNSLKTEDTAVYYCVRHGNFGNSYVSWFAVWGQGTLVTVSS
huSP34_HC8    ASVKGRFTISRDDSKNSLYLQMNSLKTEDTAVYYCVRHGNFGHSYVSWFAVWGQGTLVTVSS
huSP34_HC9    ASVKGRFTISRDDSKNSLYLQMNSLKTEDTAVYYCVRHGNFGNSYVSWFAVWGQGTLVTVSS
huSP34_HC10   ASVKGRFTISRDDSKNSLYLQMNSLKTEDTAVYYCVRHGNFGHSYVSWFAVWGQGTLVTVSS
```

Fig. 4A

```
mSP34           QAVVTQESALTTSPGETVTLTCRSSTGAVTTSNYANWVQEKPDHLFTGLIGGTNKRAPG
IGLV7-46_IGLJ3  QAVVTQEPSLTVSPGGTVTLTCGSSTGAVTSGHYPYWFQQKPGQAPRTLIYDTSNKHSW
huSP34_LC1      QAVVTQEPSLTVSPGGTVTLTCRSSTGAVTTSNYANWVQQKPGQAPRGLIGGTNKRAPW
huSP34_LC2      QAVVTQEPSLTVSPGGTVTLTCGSSTGAVTTSNYANWVQQKPGQAPRGLIGGTNKRAPW
huSP34_LC3      QAVVTQEPSLTVSPGGTVTLTCGSSTGAVTTGHYANWVQQKPGQAPRGLIGGTNKRAPW
huSP34_LC4      QAVVTQEPSLTVSPGGTVTLTCGSSTGAVTTSHYANWVQQKPGQAPRGLIGGTSKRAPW
huSP34_LC5      QAVVTQEPSLTVSPGGTVTLTCGSSTGAVTTGHYANWVQQKPGQAPRGLIGGTSNRAPW
huSP34_LC6      QAVVTQPPSLTVSPGGTVTLTCGSSTGAVTTGHYANWVQQKPGQAPRGLIGGTSNRAPG mSP34           VPARFSGSLIGDKAALTIGAQTEDEAIYFCALWYSNLWVFGGGTKLTVL
IGLV7-46_IGLJ3  TPARFSGSLLGGKAALTLSGAQPEDEAEYYCLLSYSARWVFGGGTKLTVL
huSP34_LC1      TPARFSGSLLGGKAALTLSGAQPEDEAEYYCALWYSNLWVFGGGTKLTVL
huSP34_LC2      TPARFSGSLLGGKAALTLSGAQPEDEAEYYCALWYSNLWVFGGGTKLTVL
huSP34_LC3      TPARFSGSLLGGKAALTLSGAQPEDEAEYYCALWYSNLWVFGGGTKLTVL
huSP34_LC4      TPARFSGSLLGGKAALTLSGAQPEDEAEYYCALWYSALWVFGGGTKLTVL
huSP34_LC5      TPARFSGSLLGGKAALTLSGAQPEDEAEYYCALWYSARWVFGGGTKLTVL
huSP34_LC6      VPARFSGSLSGGKAALTLSGAQPEDEAEYYCALWYSARWVFGGGTKLTVL
```

*Fig. 4B*

```
mSP34            EVKLLESGGGLVQPKGSLKLSCAASGFTFNTYAMNWVRQAPGKGLEWVARIRSKYNNYATYYA
IGHV3-72_IGHJ6   EVQLVESGGGLVQPGGSLRLSCAASGFTFSDHYMDWVRQAPGKGLEWVGRTRNKANSYTTEYA
huSP34_HC3       EVQLVESGGGLVQPGGSLRLSCAASGFTFNTYAMNWVRQAPGKGLEWVGRIRSKYNNYATYYA
huSP34_HC11      EVQLVESGGGLVQPGGSLRLSCAASGFTFSTYAMNWVRQAPGKGLEWVARIRSKYNNYATYYA
huSP34_HC12      EVQLVESGGGLVQPGGSLRLSCAASGFTFSTYAMNWVRQAPGKGLEWVGRIRSKYNNYATYYA
huSP34_HC13      EVQLVESGGGLVQPGGSLRLSCAASGFTFSTYAMNWVRQAPGKGLEWVGRIRSKYNNYATYYA mSP34            DSVKDRFTISRDDSQSILYLQMNNLKTEDTAMYYCVRHGNFGNSYVSWFAY----------YEDYWGQGTLVTVSA
IGHV3-72_IGHJ6   ASVKGRFTISRDDSKNSLYLQMNSLRTEDTAVYYCARY-----------YFDYWGQGTLVTVSS
huSP34_HC3       DSVKDRFTISRDDSKNSLYLQMNSLRTEDTAVYYCVRHGNFGHSYVSWFAYWGQGTLVTVSS
huSP34_HC11      ASVKGRFTISRDDSKNSLYLQMNSLRTEDTAVYYCVRHGNFGHSYVSWFAYWGQGTLVTVSS
huSP34_HC12      ASVKGRFTISRDDSKNSLYLQMNSLRTEDTAVYYCVRHGNFGHSYVSWFAYWGQGTLVTVSS
huSP34_HC13      ASVKGRFTISRDDSKNTLYLQMNSLRTEDTAVYYCVRHGNFGHSYVSWFAYWGQGTLVTVSS
```

*Fig. 5A*

```
mSP34          QAVVTQESALTTSPGETVTLTCRSSTGAVTTSNYANWVQEKPDHLFTGLIGGTNKRAPG
IGLV7-46_IGLJ3 QAVVTQEPSLTVSPGGTVTLTCRSSTGAVTSGHYPYWFQQKPGQAPRTLIYDTSNKHSW
huSP34_LC7     QAVVTQEPSLTVSPGGTVTLTCRSSTGAVTTGHYANWVQQKPGQAPRGLIGGTNKRAPG
huSP34_LC8     QAVVTQEPSLTVSPGGTVTLTCGSSTGAVTTGHYANWVQQKPGQAPRGLIGGTNKRAPG
huSP34_LC9     QAVVTQPPSLTVSPGGTVTLTCGSSTGAVTTGHYANWVQQKPGQAPRGLIGGTNKRAPG
huSP34_LC10    QAVVTQPPSLTVSPGGTVTLTCGSSTGAVTTGHYANWVQQKPGQAPRGLIGGTNKRAPG mSP34          VPARFSGSLIGDKAALTITGAQTEDEAIYFCALWYSNLWVFGGGTKLTVL
IGLV7-46_IGLJ3 TPARFSGSLLGGKAALTLSGAQPEDEAEYYCLLSYSARWVFGGGTKLTVL
huSP34_LC7     VPARFSGSLIGGKAALTISGAQPEDEAEYYCALWYSNLWVFGGGTKLTVL
huSP34_LC8     VPARFSGSLLGGKAALTISGAQPEDEAEYYCALWYSNRWVFGGGTKLTVL
huSP34_LC9     VPARFSGSLSGGKAALTISGAQPEDEAEYYCALWYSNLWVFGGGTKLTVL
huSP34_LC10    VPARFSGSLSGGKAALTISGAQPEDEAEYYCALWYSNRWVFGGGTKLTVL
```

*Fig. 5B*

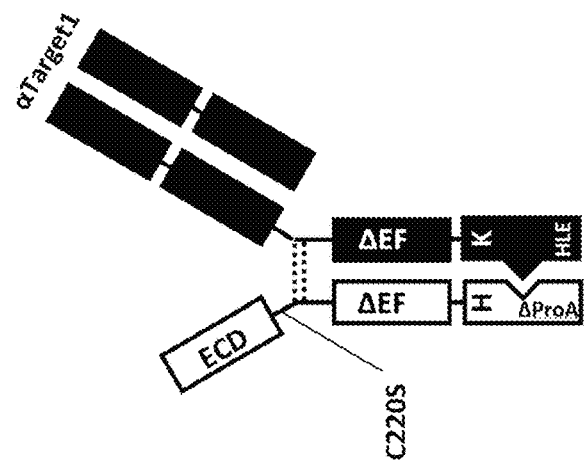
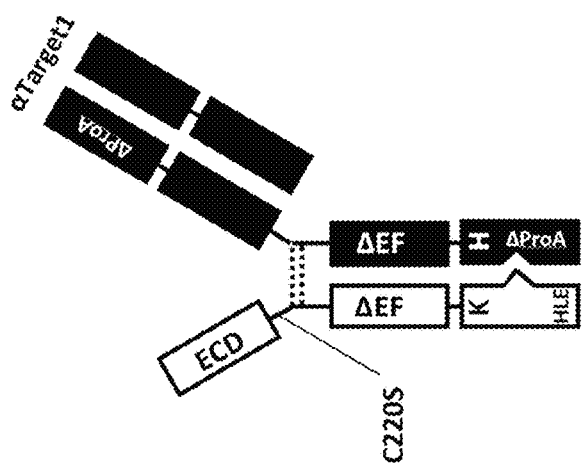
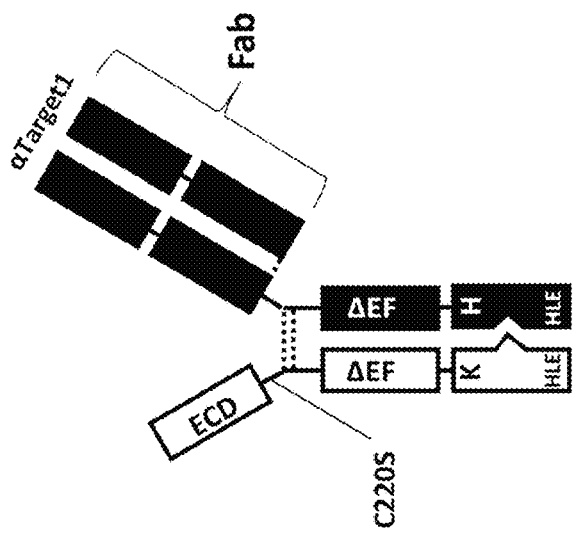
Fig. 7B

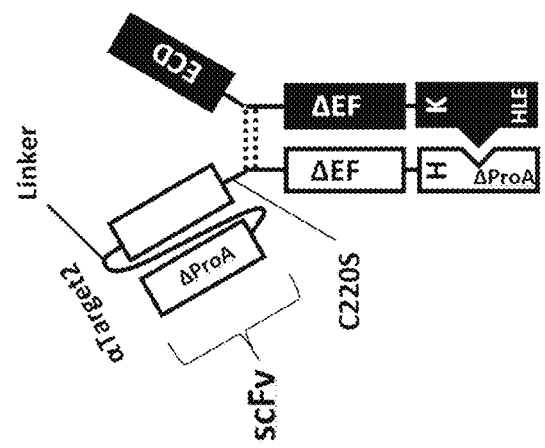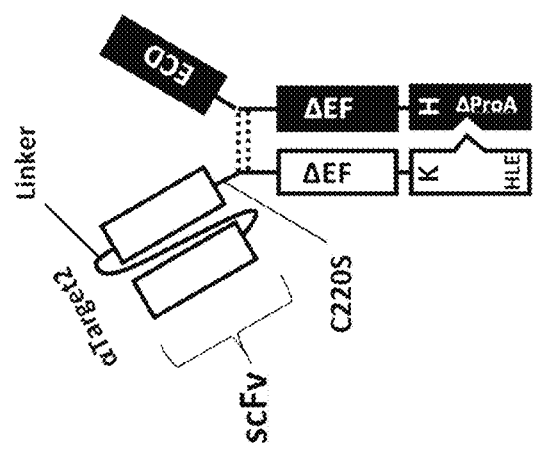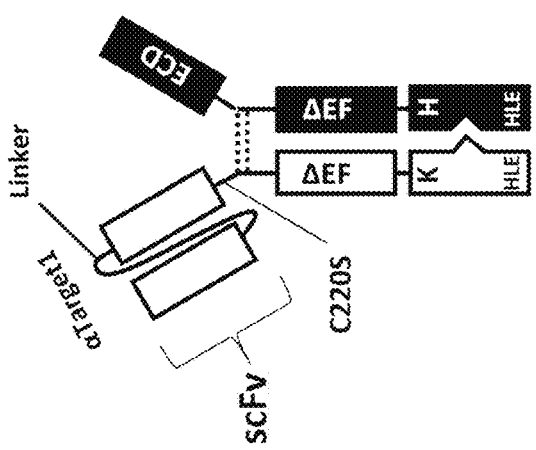
Fig. 7C

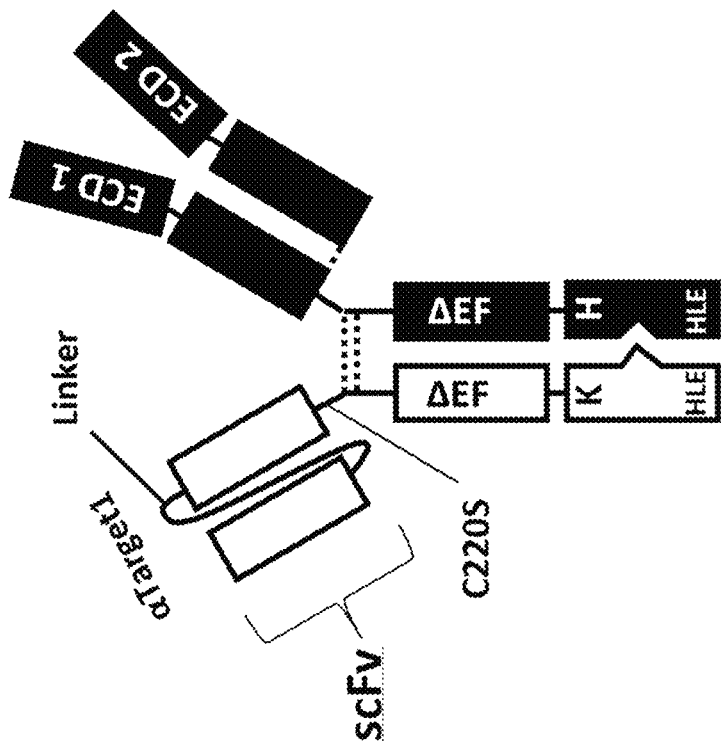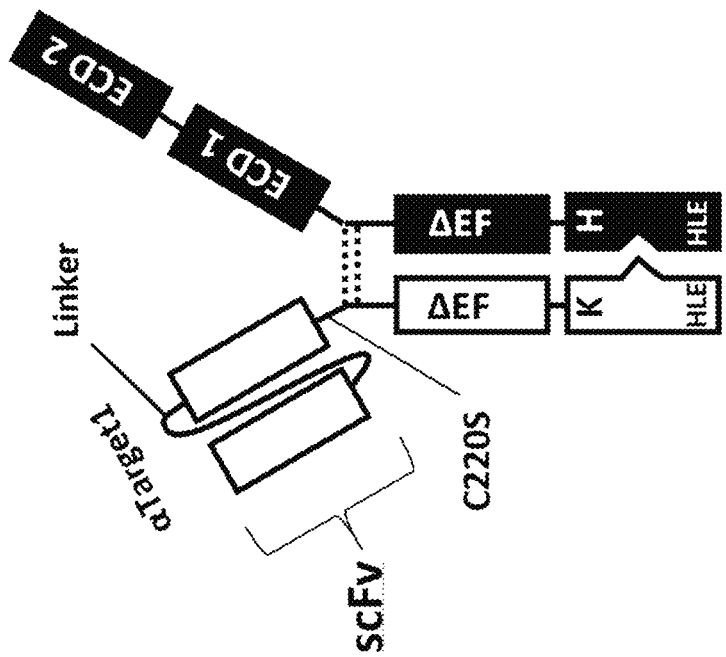
Fig. 7D

MULTI-SPECIFIC ANTIGEN BINDING MOLECULES TARGETING HIV AND METHODS OF USE

CROSS-REFERENCE TO RELATED APPLICATIONS

This application claims the benefit under 35 U.S.C. § 119(e) of U.S. Provisional Application No. 63/070,141, filed on Aug. 25, 2020 and U.S. Provisional Application No. 63/163,713, filed on Mar. 19, 2021, which are hereby incorporated herein by reference in their entireties for all purposes.

FIELD

Provided are multi-specific antigen binding molecules and antigen binding fragments thereof for one or both of the treatment and the prevention of human immunodeficiency virus (HIV) infection.

SEQUENCE LISTING

The instant application contains a Sequence Listing which has been submitted electronically in ASCII format and is hereby incorporated by reference in its entirety. Said ASCII copy, created on Jun. 25, 2021, is named 1337-US-NP_SL.txt and is 1,167,237 bytes in size.

BACKGROUND

Human immunodeficiency virus (HIV) infection and related diseases are a major public health problem worldwide. Most currently approved therapies for HIV infection target the viral reverse transcriptase, protease enzymes, and integrase. Yet resistance of HIV to these existing drugs, long-term toxicity, and lack of patient adherence to daily dosing regimens have been associated with these therapies. Therefore, it is important to discover and develop new anti-HIV antibodies with advantageous properties suitable for therapeutic uses.

WO 2005/058963; WO 2010/107939; WO 2012/030904; WO 2012/158948; WO 2013/090644; WO 2013/016468; WO 2013/192589; WO 2014/063059 and WO 2018/125813 describe human anti-HIV antibodies derived from memory B cells of HIV-infected donors, which are capable of inhibiting infection by HIV-1 species from a plurality of clades. The therapeutic use of the antibodies is limited due to their intra-patient viral coverage, pharmacokinetics, induction of anti-drug antibodies, off-target binding (i.e., polyspecificity), and other properties that interfere with efficient manufacturing and storage, however.

Multi-specific antigen binding molecules are single molecules that can bind at least two different antigens. Bispecific antigen binding molecules are single molecules that can bind two different antigens. This property can be leveraged in a number of ways to improve the efficacy and/or selectivity of biotherapeutics, for example, by neutralizing the activity of two disease mediators instead of one, enhancing selective binding to disease over normal tissue, generating novel functions (e.g. Factor VIII mimicry of Emicizumab) or by directly recruiting immune cells for targeted killing (e.g. Blinatumomab recruitment of CD3+ T-cells to kill CD19+ B-cells). As such, the field of bispecific antibodies is rapidly growing, with potential applications in nearly every therapeutic area. There are currently three approved bispecific products (Blinatumomab, Ebmicizumab and Catumaxomab) and more than 50 clinical trials underway (antibodysociety.org).

A large number of different bispecific antibody formats have been described, with many of these being used to develop therapeutic molecules (e.g., reviewed in Spiess and Carter, 2015, Mol. Immunol, 67: 95-106). Production of bispecific antibodies is typically more complex than that of conventional antibodies. For instance, generation of Fab-arm exchanged bispecifics such as the Genmab Duobody platform (Labrijn et. al., 2013, PNAS, 110: 5145-5150) requires separate production of each half-antibody (as an IgG), then mixing these together under special conditions that enables Fab arm exchange of the two half antibodies to generate the desired bispecific molecule. The need for separate cell lines to produce each half antibody (or parental unreacted reduced antibody) IgG, purification of these intermediates, and optimization of the Fab arm exchange reaction and process to purify the target bispecific away from residual half antibody IgG adds significant time and complexity to research and development.

Other bispecific format strategies, such as those that pair an scFv fusion protein with a Fab-Fc fusion protein (e.g., WO 2016/086196; WO 2016/071004), ensure that there is only a single light chain as a strategy to avoid Fab arm exchange. Challenges with bispecific formats that include an scFv arise because the scFv moiety oftentimes does not bind the target antigen with desired affinity, can have undesirable off-target binding, and can contribute to a bispecific molecule that does not express well, is difficult to purify and has insufficient serum half-life to allow efficacy for an intended indication.

SUMMARY

In one aspect, provided is are multi-specific (e.g., bispecific) antigen binding molecules that binds to human CD3 and an HIV antigen.

In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-complementarity determining region (CDR) 1 comprising the amino acid sequence of TYAMN (SEQ ID NO:1); (ii) a first VH-CDR2 comprising the amino acid sequence of RIRSKYNNYATYYAX$_1$SVKX$_2$, wherein X$_1$ is A or D and X$_2$ is G or S (SEQ ID NO:2); (iii) a first VH-CDR3 comprising the amino acid sequence of HGNFGX$_3$SYVSWFAY, wherein X$_3$ is H or N (SEQ ID NO:3); (iv) a first VL-CDR1 comprising the amino acid sequence of GSSTGAVTTGHYAN (SEQ ID NO: 4); (v) a first VL-CDR2 comprising the amino acid sequence of GTX$_4$X$_5$RAP, wherein X$_4$X$_5$ is SN or NK (SEQ ID NO:5); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to Kabat; and (b) a second antigen binding domain that binds to an HIV antigen. In some embodiments, the multi-specific (e.g., bispecific) antigen binding molecule that binds to human CD3 and a second antigen, wherein the antigen binding molecule comprises: (a) a first antigen binding domain that comprises a first heavy chain variable domain (VH) and a first light chain variable domain (VL), wherein the first antigen binding domain binds to CD3 and comprises: (i) a first VH-complementarity determining region (CDR) 1 comprising the amino acid sequence of TYAMN (SEQ ID NO:1); (ii) a first VH-CDR2 comprising the amino acid sequence of RIRSKYNNYATYYAX$_1$SVKX$_2$, wherein X$_1$ is A or D and X$_2$ is G or S (SEQ ID NO:2); (iii) a first VH-CDR3 comprising the amino acid sequence of HGNFGX$_3$SYVSWFAY, wherein X$_3$ is H or N (SEQ ID NO:3); (iv) a first VL-CDR1 comprising the amino acid sequence of GSSTGAVTTGHYAN (SEQ ID NO: 4); (v) a first VL-CDR2 comprising the amino acid sequence of GTX$_4$X$_5$RAP, wherein X$_4$X$_5$ is SN or NK (SEQ ID NO:5); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to Kabat; and (b) a second antigen binding domain that binds to a second antigen. In some embodiments (i) the first VH-complementarity determining region (CDR) 1 comprises the amino acid sequence of TYAMN (SEQ ID NO:1); (ii) the first VH-CDR2 comprises the amino acid sequence of RIRSKYNNYATYYADSVKX$_2$, wherein X$_2$ is G or S (SEQ ID NO:7); (iii) the first VH-CDR3 comprises the amino acid sequence of HGNFGHSYVSWFAY (SEQ ID NO:8); (iv) the first VL-CDR1 comprises the amino acid sequence of GSSTGAVTTGHYAN (SEQ ID NO: 4); (v) the first VL-CDR2 comprises the amino acid sequence of GTSNRAP (SEQ ID NO:9); and (vi) the first VL-CDR3 comprises the amino acid sequence of ALWYSNRWV (SEQ ID NO:10). In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): (i) SEQ ID NOs: 1, 11, 8, 4, 5 and 10; (ii) SEQ ID NOs: 1, 11, 8, 4, 9 and 10; (iii) SEQ ID NOs: 1, 12, 8, 4, 9 and 10; (iv) SEQ ID NOs: 1, 13, 8, 4, 14 and 15; (v) SEQ ID NOs: 1, 13, 16, 4, 14 and 15; or (vi) SEQ ID NOs: 1, 11, 8, 4, 14 and 10. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): (i) SEQ ID NOs: 1, 11, 8, 4, 9 and 10; or (ii) SEQ ID NOs: 1, 12, 8, 4, 9 and 10. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 11, 8, 4, 9 and 10. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 12, 8, 4, 9 and 10.

In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of GFTFNTY (SEQ ID NO:17); (ii) a first VH-CDR2 comprising the amino acid sequence of SKYNNY (SEQ ID NO:18); (iii) a first VH-CDR3 comprising the amino acid sequence of GNFGX$_3$SYVSWFA, wherein X$_3$ is H or N (SEQ ID NO:19); (iv) a first VL-CDR1 comprising the amino acid sequence of SSTGAVTTGHY (SEQ ID NO: 20); (v) a first VL-CDR2 comprising the amino acid sequence of GTX$_4$, wherein X$_4$ is N or S (SEQ ID NO:21); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Chothia; and (b) a second antigen binding domain that binds to an HIV antigen. In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of GFTFNTY (SEQ ID NO:17); (ii) a first VH-CDR2 comprising the amino acid sequence of SKYNNY (SEQ ID NO:18); (iii) a first VH-CDR3 comprising the amino acid sequence of GNFGX$_3$SYVSWFA, wherein X$_3$ is H or N (SEQ ID NO:19); (iv) a first VL-CDR1 comprising the amino acid sequence of SSTGAVTTGHY (SEQ ID NO: 20); (v) a first VL-CDR2 comprising the amino acid sequence of GTX$_4$, wherein X$_4$ is N or S (SEQ ID NO:21); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Chothia; and (b) a second antigen binding domain that binds to a second antigen. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): (i) SEQ ID NOs: 17, 18, 23, 20, 21 and 25; (ii) SEQ ID NOs: 17, 18, 23, 20, 24 and 25; (iii) SEQ ID NOs: 17, 18, 23, 20, 26 and 27; (iv) SEQ ID NOs: 17, 18, 75, 20, 26 and 27; or (v) SEQ ID NOs: 17, 18, 23, 20, 26 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): SEQ ID NOs: 17, 18, 23, 20, 24 and 25.

In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of GFTFNTYA (SEQ ID NO:28); (ii) a first VH-CDR2 comprising the amino acid sequence of IRSKYNNYAT (SEQ ID NO:29); (iii) a first VH-CDR3 comprising the amino acid sequence of VRHGNFGX$_3$SYVSWFAY, wherein X$_3$ is H or N (SEQ ID NO:30); (iv) a first VL-CDR1 comprising the amino acid sequence of TGAVTTGHY (SEQ ID NO:31); (v) a first VL-CDR2 comprising the amino acid sequence of GTX$_4$, wherein X$_4$ is N or S (SEQ ID NO:21); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to IMGT; and (b) a second antigen binding domain that binds to an HIV antigen. In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of GFTFNTYA (SEQ ID NO:28); (ii) a first VH-CDR2 comprising the amino acid sequence of IRSKY- NNYAT (SEQ ID NO:29); (iii) a first VH-CDR3 comprising the amino acid sequence of VRHGNFGX$_3$SYVSWFAY, wherein X$_3$ is H or N (SEQ ID NO:30); (iv) a first VL-CDR1 comprising the amino acid sequence of TGAVTTGHY (SEQ ID NO:31); (v) a first VL-CDR2 comprising the amino acid sequence of GTX$_4$, wherein X$_4$ is N or S (SEQ ID NO:21); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to IMGT; and (b) a second antigen binding domain that binds to a second antigen. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): (i) SEQ ID NOs: 28, 29, 32, 31, 21 and 10; (ii) SEQ ID NOs: 28, 29, 32, 31, 24 and 10; (iii) SEQ ID NOs: 28, 29, 32, 31, 26 and 15; (iv) SEQ ID NOs: 28, 29, 33, 31, 26 and 15; or (v) SEQ ID NOs: 28, 29, 32, 31, 26 and 10. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): SEQ ID NOs: 28, 29, 32, 31, 24 and 10.

In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of ASGFTFNTYA (SEQ ID NO:34); (ii) a first VH-CDR2 comprising the amino acid sequence of IRSKYNNYATYYAX$_1$SVKX$_2$R, wherein X$_1$ is A or D and X$_2$ is G or S (SEQ ID NO:35); (iii) a first VH-CDR3 comprising the amino acid sequence of HGNFGX$_3$SYVSWFA, X$_3$ is H or N (SEQ ID NO:36); (iv) a first VL-CDR1 comprising the amino acid sequence of SSTGAVTTGHY (SEQ ID NO: 37); (v) a first VL-CDR2 comprising the amino acid sequence of GTX$_4$NRAPX$_7$VPAR, wherein X$_4$ is N or S and X$_7$ is G or W (SEQ ID NO:38); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Honegger; and (b) a second antigen binding domain that binds to an HIV antigen. In some embodiments, the multi-specific (e.g., bispecific) antigen binding molecule comprises: (a) a first antigen binding domain that comprises a first heavy chain variable domain (VH) and a first light chain variable domain (VL), wherein the first antigen binding domain binds to CD3 and comprises: (i) a first VH-CDR1 comprising the amino acid sequence of ASGFTFNTYA (SEQ ID NO:34); (ii) a first VH-CDR2 comprising the amino acid sequence of IRSKYNNYATYYAX$_1$SVKX$_2$R, wherein X$_1$ is A or D and X$_2$ is G or S (SEQ ID NO:35); (iii) a first VH-CDR3 comprising the amino acid sequence of HGNFGX$_3$SYVSWFA, X$_3$ is H or N (SEQ ID NO:36); (iv) a first VL-CDR1 comprising the amino acid sequence of SSTGAVTTGHY (SEQ ID NO: 37); (v) a first VL-CDR2 comprising the amino acid sequence of GTX$_4$NRAPX$_7$VPAR, wherein X$_4$ is N or S and X$_7$ is G or W (SEQ ID NO:38); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Honegger; and (b) a second antigen binding domain that binds to a second antigen. In some embodiments, (i) the first VH-CDR1 comprises the amino acid sequence of ASGFTFN-TYA (SEQ ID NO:34); (ii) the first VH-CDR2 comprises the amino acid sequence of IRSKYNNYATYYADSVKX$_2$R, wherein X$_2$ is G or S (SEQ ID NO:39); (iii) the first VH-CDR3 comprises the amino acid sequence of HGNFGHSYVSWFA (SEQ ID NO:40); (iv) the first VL-CDR1 comprises the amino acid sequence of SST-GAVTTGHY (SEQ ID NO: 37); (v) the first VL-CDR2 comprises the amino acid sequence of GTSNRAPGVPAR (SEQ ID NO:41); and (vi) the first VL-CDR3 comprises the amino acid sequence of WYSNRW (SEQ ID NO:25). In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): (i) SEQ ID NOs: 34, 39, 40, 37, 41 and 25; (ii) SEQ ID NOs: 34, 42, 40, 37, 41 and 25; (iii) SEQ ID NOs: 34, 43, 40, 37, 41 and 25; (iv) SEQ ID NOs: 34, 44, 40, 37, 45 and 27; (v) SEQ ID NOs: 34, 44, 46, 37, 45 and 27; or (vi) SEQ ID NOs: 34, 42, 40, 37, 47 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): (i) SEQ ID NOs: 34, 42, 40, 37, 41 and 25; or (ii) SEQ ID NOs: 34, 43, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 42, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 42, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 43, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 43, 40, 37, 41 and 25.

With respect to further embodiments of the first antigen binding domain of the multi-specific (e.g., bispecific) antigen binding molecules targeting or binding to CD3, in some embodiments, the multi-specific (e.g., bispecific) antigen binding molecule comprises one or more of the following amino acid substitutions (numbering according to Kabat): position 81 of the first VH is Q or E; position 83 of the first VH is K or R; position 89 of the first VH is M or V; position 100 of the first VH is H; position 57 of the first VL is G or W; and/or position 75 of the first VL is I or L. In some embodiments, the multi-specific (e.g., bispecific) antigen binding molecule comprises: one or more of the following amino acid substitutions (numbering according to Kabat): (i) position 81 of the first VH is Q or E; (ii) position 83 of the first VH is R; (iii) position 89 of the first VH is V; (iv) position 100 of the first VH is H; (v) position 57 of the first VL is G; and/or (vi) position 75 of the first VL is I. In some embodiments, position 81 of the first VH (numbering according to Kabat) is E. In some embodiments, position 81 of the first VH (numbering according to Kabat) is Q. In some embodiments, position 100 of the first VH (numbering according to Kabat) is H. In some embodiments, the first VH comprises an amino acid sequence selected from the group consisting of SEQ ID NOs: 48-53, or comprises an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from the group consisting of SEQ ID NOs: 48-53. In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 50. In some embodiments, the first VH comprises the amino acid sequence of SEQ ID NO: 50. In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 51. In some embodiments, the first VH comprises the amino acid sequence of SEQ ID NO: 51. In some embodiments, the first VL comprises an amino acid sequence selected from the group consisting of SEQ ID NOs: 54-58, or comprises an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from the group consisting of SEQ ID NOs: 54-58. In some embodiments, the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VL comprises the amino acid sequence of SEQ ID NO: 56. In some embodiments, the first VH comprises an amino acid sequence selected from the group consisting of SEQ ID NOs: 48-53, or comprises an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from the group consisting of SEQ ID NOs: 48-53 and wherein the first VL comprises an amino acid sequence selected from the group consisting of SEQ ID NOs: 54-58, or comprises an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from the group consisting of SEQ ID NOs: 54-58. In some embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 48 and 54; SEQ ID NOs: 49 and 55; SEQ ID NOs: 50 and 55; SEQ ID NOs: 50 and 56; SEQ ID NOs: 51 and 55; SEQ ID NOs: 51 and 56; SEQ ID NOs: 52 and 56; SEQ ID NOs: 53 and 57; or SEQ ID NOs: 50 and 58. In some embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56. In some embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 50 and 56. In some embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56. In some embodiments, at least one of the first antigen binding domain and the second antigen binding domain independently comprise a Fab, an F(ab)2, Fv, a scFv, a sc(Fv)2, or a diabody. In some embodiments, the first antigen binding domain comprises a scFv and the second antigen binding domain comprises a Fab. In some embodiments, the first antigen binding domain comprises a scFv and the second antigen binding domain comprises a Fab, wherein the first VH and the first VL comprise the amino acid sequences set forth, respectively: SEQ ID NOs: 50 and 56. In some embodiments, the first antigen binding domain comprises a Fab and the second antigen binding domain comprises a scFv. In some embodiments, the first antigen binding domain comprises a Fab and the second antigen binding domain comprises a Fab. In some embodiments, the first antigen binding domain comprises a scFv and the second antigen binding domain comprises a scFv. In some embodiments, the first antigen binding domain comprises a Fab and the second antigen binding domain comprises an extracellular domain of CD4. In some embodiments, the first antigen binding domain comprises a Fab and the second antigen binding domain comprises an extracellular domain of CD4, wherein the first VH and the first VL comprise the amino acid sequences set forth, respectively: SEQ ID NOs: 51 and 56. In some embodiments, the first antigen binding domain comprises a scFv and the second antigen binding domain comprises an extracellular domain of CD4. In some embodiments, the first antigen binding domain is a scFv comprising a cysteine (C) at position 44 in the scFv variable heavy domain; and a cysteine (C) at position 100 in the scFv variable light domain. In some embodiments, the first antigen binding domain is a scFv comprising a VH and a VL, the scFv comprising an amino acid sequence selected from SEQ ID NOs: 59-66, or comprising an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from SEQ ID NOs: 59-66. In some embodiments, the first antigen binding domain is a scFv comprising a VH and a VL, the scFv comprising an amino acid sequence selected from SEQ ID NOs: 59-63, or comprising an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from SEQ ID NOs: 59-63. In some embodiments, the first antigen binding domain is a scFv comprising a VH and a VL, the scFv comprising an amino acid sequence selected from SEQ ID NOs: 62-63, or comprising an amino acid sequence that is at least 80%, at least 85%, at least 90%, at least 91%, at least 92%, at least 93%, at least 94%, at least 95%, at least 96%, at least 97%, at least 98%, or at least 99% identical to an amino acid sequence selected from SEQ ID NOs: 62-63.

With respect to further embodiments of the second antigen binding domain of the multi-specific (e.g., bispecific) antigen binding molecules targeting or binding to an HIV antigen, in some embodiments, the second antigen binding domain binds to an HIV envelope protein selected from the group consisting of gp120 and gp41. In some embodiments, the second antigen binding domain competes with or comprises VH and VL variable domains of a broadly neutralizing antibody (bNAb) that binds to an HIV antigen. In some embodiments, the second antigen binding domain binds to an epitope or region of gp120 selected from the group consisting of: third variable loop (V3) (e.g., high mannose patch) comprising a N332 oligomannose glycan; second variable loop (V2) (e.g., Env trimer apex); CD4 binding site (CD4bs); gp120/gp41 interface; or silent face of gp120. In some embodiments, the second antigen binding domain binds to an epitope or region of gp120 in the third variable loop (V3) (e.g., high mannose patch) comprising a N332 oligomannose glycan and competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second antigen binding domain binds to an epitope or region of gp120 in the second variable loop (V2) (e.g., Env trimer apex) and competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. In some embodiments, the second antigen binding domain binds to an epitope or region of gp120 in the CD4 binding site (CD4bs) and competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the second antigen binding domain binds to an epitope or region of gp120 in the CD4 binding site (CD4bs) and comprises one or more extracellular (EC) domains of CD4. In some embodiments, the one or more EC domains of CD4 comprise a sequence as set forth below, or a sequence that is at least 80%, at least 85%, at least 90%, at least 91%, at least 92%, at least 93%, at least 94%, at least 95%, at least 96%, at least 97%, at least 98%, or at least 99% identical to a sequence selected from the group consisting of:

(i)
(SEQ ID NO: 746)
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVG;

(ii)
(SEQ ID NO: 747)
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVGG

GGSGKKVVYGKKGDTVELTCTASQKKNIQFHWKNSNQIKILGNQGSFLTK

GPSKLNDRVDSRRSLWDQGNFPLIIKNLKPEDSDTYICEVEDQKEEVQLV

VVG;

(iii)
(SEQ ID NO: 748)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFG;
or (iv)
(SEQ ID NO: 749)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFGG

GGSGKKVVLGKKGDTVELTCTASQKKSIQFHWKNSNQIKILGNQGSFLTK

GPSKLNDRADSRRSLWDQGNFPLIIKNLKIEDSDTYICEVEDQKEEVQLL

VFG.

In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the second antigen binding domain binds to an epitope or region of gp120 in the gp120/gp41 interface and competes with or comprises VH and VL regions from an antibody selected from the group consisting of PGT-151, CAP248-2B, 35O22, 8ANC195, ACS202, VRC34 and VRC34.01. In some embodiments, the second antigen binding domain binds to an epitope or region of the gp120 silent face and competes with or comprises VH and VL regions from an antibody selected from VRC-PG05 and SF12. In some embodiments, the second antigen binding domain binds to an epitope or region of gp41 in the membrane proximal region (MPER). In some embodiments, the second antigen binding domain binds to an epitope or region of gp41 in the membrane proximal region (MPER) and competes with or comprises VH and VL regions from an antibody selected from the group consisting of 10E8, 10E8v4, 10E8-5R-100cF, 4E10, DH511.11P, 2F5, 7b2, and LN01. In some embodiments, the second antigen binding domain binds to an epitope or region of the gp41 fusion peptide and competes with or comprises VH and VL regions from an antibody selected from the group consisting of VRC34 and ACS202. In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to Kabat) set forth, respectively, in: SEQ ID NOs: 76, 77, 78, 79, 80 and 81; SEQ ID NOs: 76, 82, 78, 79, 80 and 81; SEQ ID NOs: 83, 84, 85, 86, 80 and 87; SEQ ID NOs: 83, 88, 85, 86, 80 and 87; SEQ ID NOs: 90, 91, 92, 93, 94 and 95; SEQ ID NOs: 90, 91, 96, 93, 94 and 95; SEQ ID NOs: 97, 98, 99, 100, 101 and 102; SEQ ID NOs: 103, 104, 105, 106, 94 and 107; SEQ ID NOs: 108, 109, 110, 111, 112 and 113; SEQ ID NOs: 114, 115, 116, 117, 118 and 119; SEQ ID NOs: 114, 120, 121, 122, 118 and 123; SEQ ID NOs: 124, 125, 126, 127, 128 and 113; SEQ ID NOs: 129, 115, 131, 127, 118 and 113; SEQ ID NOs: 132, 133, 134, 135, 136 and 137; SEQ ID NOs: 138, 139, 140, 141, 142 and 143; SEQ ID NOs: 144, 145, 146, 147, 148 and 143; SEQ ID NOs: 149, 150, 151, 152, 153 and 143; SEQ ID NOs: 154, 155, 156, 157, 158 and 159; SEQ ID NOs: 160, 161, 162, 163, 164 and 165; SEQ ID NOs: 166, 161, 167, 163, 164 and 165; SEQ ID NOs: 168, 169, 170, 171, 172 and 173; SEQ ID NOs: 168, 174, 170, 171, 172 and 173; SEQ ID NOs: 175, 176, 177, 171, 172 and 173; SEQ ID NOs: 178, 179, 180, 181, 182 and 183; SEQ ID NOs: 184, 185, 186, 187, 188 and 189; SEQ ID NOs: 190, 191, 192, 193, 194 and 195; SEQ ID NOs: 196, 197, 198, 199, 200 and 201; SEQ ID NOs: 202, 203, 204, 205, 206 and 207; SEQ ID NOs: 208, 209, 210, 211, 212 and 213; SEQ ID NOs: 214, 215, 216, 217, 218 and 219; SEQ ID NOs: 214, 220, 216, 221, 218 and 219; SEQ ID NOs: 214, 220, 222, 221, 218 and 219; SEQ ID NOs: 223, 224, 225, 226, 227 and 228; SEQ ID NOs: 229, 230, 231, 232, 233 and 234; SEQ ID NOs: 902, 903, 904, 905, 906 and 907; SEQ ID NOs: 908, 909, 910, 911, 912 and 913; SEQ ID NOs: 914, 915, 916, 917, 918 and 919; or SEQ ID NOs: 920, 921, 922, 923, 924 and 925. In some embodiments, the second antigen binding domain comprises a second VH comprising a second VH-CDR1, a second VH-CDR2, and a second VL comprising a second VL-CDR1, a second VL-CDR2, and a second VH-CDR3; comprising the amino acid sequences (according to Chothia) set forth, respectively, in: SEQ ID NOs: 235, 236, 237, 238, 239 and 240; SEQ ID NOs: 241, 242, 243, 244, 239 and 245; SEQ ID NOs: 246, 242, 247, 244, 239 and 245; SEQ ID NOs: 248, 249, 250, 251, 239 and 252; SEQ ID NOs: 248, 249, 253, 251, 239 and 252; SEQ ID NOs: 254, 255, 256, 257, 258 and 259; SEQ ID NOs: 260, 261, 262, 263, 239 and 264; SEQ ID NOs: 265, 266, 267, 268, 269 and 270; SEQ ID NOs: 271, 272, 273, 274, 275 and 270; SEQ ID NOs: 271, 276, 277, 278, 275 and 279; SEQ ID NOs: 280, 281, 282, 283, 284 and 270; SEQ ID NOs: 285, 272, 286, 283, 275 and 270; SEQ ID NOs: 287, 288, 289, 290, 291 and 292; SEQ ID NOs: 293, 294, 295, 296, 297 and 298; SEQ ID NOs: 299, 300, 301, 302, 303 and 298; SEQ ID NOs: 304, 300, 305, 406, 307 and 298; SEQ ID NOs: 308, 309, 310, 311, 312 and 313; SEQ ID NOs: 314, 315, 316, 317, 318 and 165; SEQ ID NOs: 320, 315, 321, 317, 318 and 165; SEQ ID NOs: 322, 323, 324, 325, 326 and 327; SEQ ID NOs: 322, 328, 324, 325, 326 and 327; SEQ ID NOs: 329, 323, 330, 325, 326 and 327; SEQ ID NOs: 331, 332, 333, 334, 335 and 336; SEQ ID NOs: 337, 338, 339, 340, 341 and 342; SEQ ID NOs: 343, 344, 345, 346, 341 and 347; SEQ ID NOs: 348, 349, 350, 351, 352 and 353; SEQ ID NOs: 354, 355, 356, 357, 358 and 359; SEQ ID NOs: 360, 361, 362, 363, 364 and 365; SEQ ID NOs: 366, 367, 368, 369, 370 and 371; SEQ ID NOs: 366, 361, 368, 369, 370 and 371; SEQ ID NOs: 372, 361, 373, 369, 370 and 371; SEQ ID NOs: 374, 375, 376, 377, 378 and 379; SEQ ID NOs: 380, 381, 382, 383, 384 and 385; SEQ ID NOs: 926, 927, 928, 929, 930 and 931; SEQ ID NOs: 932, 933, 934, 935, 936 and 937; SEQ ID NOs: 938, 939, 940, 941, 942 and 943; or SEQ ID NOs: 944, 945, 946, 947, 948 and 949. In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to IMGT) set forth, respectively, in: SEQ ID NOs: 386, 387, 388, 389, 239 and 81; SEQ ID NOs: 390, 391, 392, 393, 239 and 87; SEQ ID NOs: 390, 391, 394, 393, 239 and 87; SEQ ID NOs: 395, 396, 397, 393, 239 and 87; SEQ ID NOs: 398, 399, 400, 401, 239 and 95; SEQ ID NOs: 398, 399, 402, 401, 239 and 95; SEQ ID NOs: 403, 404, 405, 406, 258 and 102; SEQ ID NOs: 407, 408, 409, 410, 239 and 107; SEQ ID NOs: 411, 412, 413, 414, 269 and 113; SEQ ID NOs: 415, 416, 417, 418, 275 and 119; SEQ ID NOs: 415, 419, 420, 421, 275 and 123; SEQ ID NOs: 422, 423, 424, 425, 275 and 113; SEQ ID NOs: 426, 416, 427, 425, 275 and 113; SEQ ID NOs: 428, 429, 430, 431, 291 and 137; SEQ ID NOs: 432, 433, 434, 435, 297 and 143; SEQ ID NOs: 436, 437, 438, 439, 303 and 143; SEQ ID NOs: 440, 437, 441, 442, 307 and 143; SEQ ID NOs: 443, 444, 445, 446, 312 and 159; SEQ ID NOs: 447, 448, 449, 450, 318 and 165; SEQ ID NOs: 451, 448, 452, 450, 318 and 165; SEQ ID NOs: 453, 454, 455, 456, 326 and 173; SEQ ID NOs: 453, 457, 455, 456, 326 and 173; SEQ ID NOs: 458, 459, 460, 456, 326 and 173; SEQ ID NOs: 461, 462, 463, 464, 335 and 183; SEQ ID NOs: 465, 466, 467, 468, 341 and 189; SEQ ID NOs: 469, 470, 471, 472, 341 and 195; SEQ ID NOs: 473, 474, 475, 476, 352 and 201; SEQ ID NOs: 477, 478, 479, 480, 358 and 207; SEQ ID NOs: 481, 482, 483, 484, 364 and 213; SEQ ID NOs: 485, 486, 487, 488, 370 and 219; SEQ ID NOs: 485, 482, 487, 488, 370 and 219; SEQ ID NOs: 489, 482, 490, 488, 370 and 219; SEQ ID NOs: 491, 492, 493, 494, 378 and 228; SEQ ID NOs: 495, 496, 497, 498, 384 and 234; SEQ ID NOs: 950, 951, 952, 953, 930 and 907; SEQ ID NOs: 954, 955, 956, 957, 936 and 913; SEQ ID NOs: 958, 959, 960, 961, 942 and 919; or SEQ ID NOs: 962, 963, 964, 965, 948 and 925. In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to Honegger) set forth, respectively, in: SEQ ID NOs: 499, 500, 501, 238, 502 and 240; SEQ ID NOs: 499, 503, 501, 238, 502 and 240; SEQ ID NOs: 505, 506, 507, 244, 502 and 245; SEQ ID NOs: 508, 509, 510, 244, 502 and 245; SEQ ID NOs: 511, 512, 513, 251, 514 and 252; SEQ ID NOs: 511, 512, 515, 251, 514 and 252; SEQ ID NOs: 516, 517, 518, 257, 519 and 259; SEQ ID NOs: 520, 521, 522, 264, 523 and 264; SEQ ID NOs: 524, 525, 526, 268, 527 and 270; SEQ ID NOs: 528, 529, 530, 274, 531 and 270; SEQ ID NOs: 528, 532, 533, 278, 531 and 279; SEQ ID NOs: 534, 535, 536, 283, 537 and 270; SEQ ID NOs: 1090, 529, 538, 283, 531 and 270; SEQ ID NOs: 539, 540, 541, 290, 542 and 292; SEQ ID NOs: 543, 544, 545, 546, 547 and 298; SEQ ID NOs: 548, 549, 550, 1091, 551 and 298; SEQ ID NOs: 552, 553, 554, 555, 556 and 298; SEQ ID NOs: 557, 558, 559, 311, 560 and 313; SEQ ID NOs: 561, 562, 563, 564, 565 and 165; SEQ ID NOs: 566, 562, 1092, 564, 567 and 165; SEQ ID NOs: 568, 569, 570, 571, 572 and 327; SEQ ID NOs: 568, 573, 570, 571, 572 and 327; SEQ ID NOs: 574, 575, 576, 571, 572 and 327; SEQ ID NOs: 577, 578, 579, 580, 581 and 336; SEQ ID NOs: 582, 583, 584, 340, 585 and 342; SEQ ID NOs: 586, 587, 588, 346, 589 and 347; SEQ ID NOs: 590, 591, 592, 351, 593 and 353; SEQ ID NOs: 594, 595, 596, 597, 598 and 359; SEQ ID NOs: 599, 600, 601, 602, 603 and 365; SEQ ID NOs: 604, 605, 606, 607, 608 and 371; SEQ ID NOs: 604, 609, 606, 607, 608 and 371; SEQ ID NOs: 610, 609, 611, 607, 608 and 371; SEQ ID NOs: 612, 613, 614, 615, 616 and 379; SEQ ID NOs: 617, 618, 619, 620, 621 and 385; SEQ ID NOs: 966, 967, 968, 969, 970 and 931; SEQ ID NOs: 971, 972, 973, 974, 975 and 937; SEQ ID NOs: 976, 977, 978, 941, 979 and 943; or SEQ ID NOs: 980, 981, 982, 983, 984 and 949. In some embodiments, the second VH and the second VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 622 and 623; SEQ ID NOs: 624 and 625; SEQ ID NOs: 624 and 626; SEQ ID NOs: 627 and 628; SEQ ID NOs: 629 and 630; SEQ ID NOs: 631 and 632; SEQ ID NOs: 633 and 634; SEQ ID NOs: 635 and 636; SEQ ID NOs: 637 and 638; SEQ ID NOs: 639 and 640; SEQ ID NOs: 641 and 642; SEQ ID NOs: 643 and 644; SEQ ID NOs: 645 and 646; SEQ ID NOs: 647 and 648; SEQ ID NOs: 649 and 650; SEQ ID NOs: 651 and 652; SEQ ID NOs: 653 and 654; SEQ ID NOs: 655 and 656; SEQ ID NOs: 657 and 658; SEQ ID NOs: 659 and 660; SEQ ID NOs: 661 and 662; SEQ ID NOs: 663 and 664; SEQ ID NOs: 665 and 666; SEQ ID NOs: 667 and 668; SEQ ID NOs: 669 and 670; SEQ ID NOs:671 and 672; SEQ ID NOs:673 and 670; SEQ ID NOs: 674 and 675; SEQ ID NOs: 676 and 677; SEQ ID NOs: 678 and 679; SEQ ID NOs: 680 and 681; SEQ ID NOs: 682 and 683; SEQ ID NOs: 684 and 685; SEQ ID NOs: 686 and 687; SEQ ID NOs: 688 and 689; SEQ ID NOs: 690 and 691; SEQ ID NOs: 692 and 693; SEQ ID NOs: 694 and 695; SEQ ID NOs: 985 and 986; SEQ ID NOs: 987 and 988; SEQ ID NOs: 989 and 990; or SEQ ID NOs: 991 and 992. In some embodiments, the second VH and the second VL comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively, and comprising the following amino acids at the indicated positions (position numbering according to Kabat): (i) SEQ ID NOs: 622, 624 or 627, comprising one or more of: Ser-Ser-Val (SSV) or Thr-Gly-Val (TGV) at positions 82a-82c, Gln (Q) at position 39, Asn (N) at position 60, His (H) at position 68, any one of Lys (K), His (H) or Thr (T) at position 105, Leu (L) at position 2, Ala (A) at position 32, and Ala (A) at position 95; and SEQ ID NOs: 623, 625, 626 or 628, comprising one or more of: Gly (G) at position 67, Tyr (Y), Phe (F) or Thr (T) at position 67a, Arg (R) at position 67b, Pro (P) at position 67c, and Lys (K) at position 103; or (ii) SEQ ID NOs: 663, 665 or 667, comprising one or more of: His (H) at position 3, Ser (S) or Val (V) at position 5, Glu (E) at position 10, Lys (K) at position 12, Lys (K) at position 23, Asn (N) at position 28, Arg (R) at position 30, Tyr (Y) at position 32, Thr (T) at position 68, Met (M) at position 69, Gln (Q) or His (H) at position 72, Tyr (Y), Phe (F) at position 74a, Phe (F) or Ser (S) at position 76, Ser (S) at position 77, Ala (A) at position 78, Ser (S) at position 82a, Arg (R) at position 82b, Val (V) at position 82c, Ile (I) or Thr (T) at position 89, Phe (F) at position 98, Tyr (Y) or Gly (G) at position 99, Gln (Q) at position 105, Met (M) at position 108, Phe-Asp-Phe-Asp (FDFD) (SEQ ID NO: 1040) at positions 74a, 74b, 74c, and 74d and Trp-Asp-Phe-Asp (WDFD) (SEQ ID NO: 1042) at positions 74a, 74b, 74c, and 74d; and SEQ ID NOs: 664, 666 or 668, comprising one or more of Arg (R) at position 14, Arg (R) at position 18, Ala (A) at position 19, Lys (L) at position 39, Pro (P) at position 40, Thr (T) at position 56, Ala (A) at position 60, Ser (S) at position 65, Thr (T) or His (H) at position 72, Lys (K) at position 74, Ser (S) at position 76, Ser (S) at position 77, Val (V) at position 83, Ile (I) or Phe (F) at position 98, Thr (T) or Gly (G) at position 99, Asn (N) at position 103, and Ile (I) at position 106. In some embodiments, the second VH and the second VL comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively, and comprising the following amino acids at the indicated positions (position numbering according to Kabat): (i) SEQ ID NOs: 622, 624 or 627, comprising one or more of: Thr-Gly-Val (TGV) at positions 82a-82c, Asn (N) at position 60, His (H) at position 68, any one of Lys (K), His (H) and Thr (T) at position 105; and SEQ ID NOs: 623, 625, 626 or 628, comprising one or more of: Gly (G) at position 67, Tyr (Y), Phe (F) or Thr (T) at position 67a, Arg (R) at position 67b, Pro (P) at position 67c; or (ii) SEQ ID NOs: 663, 665 or 667, comprising Phe (F) at position 74a; and SEQ ID NOs: 664, 666 or 668, comprising Ala (A) at position 19.

With respect to the first and second Fc regions or domains of the multi-specific antigen binding molecules some embodiments, the multi-specific (e.g., bispecific) antigen binding molecules comprise a heterodimeric human IgG1 or IgG4, comprising a first Fc region and a second Fc region. In some embodiments, the first Fc region and the second Fc region are derived from IgG1m17. In some embodiments, the multi-specific (e.g., bispecific) antigen binding molecules comprise a heterodimeric human IgG1 or IgG4, comprising a first Fc region and a second Fc region, wherein one or both of the first and second Fc regions comprise one or more of the following amino acids at the indicated positions (EU numbering): alanine at position 234, alanine at position 235; and serine at position 331. In some embodiments, the multi-specific (e.g., bispecific) antigen binding molecules comprise a heterodimeric human IgG1, comprising a first Fc region and a second Fc region, wherein both of the first and second Fc regions comprise one or more of the following amino acids at the indicated positions (EU numbering): alanine at position 234, alanine at position 235; and serine at position 331. In some embodiments, the multi-specific (e.g., bispecific) antigen binding molecules comprise a heterodimeric human IgG1, comprising a first Fc region and a second Fc region, wherein both of the first and second Fc regions comprise the following amino acids at the indicated positions(EU numbering): alanine at position 234, alanine at position 235; and serine at position 331. In some embodiments, the multi-specific (e.g., bispecific) antigen binding molecules comprise a heterodimeric human IgG1 or IgG4, comprising a first Fc region and a second Fc region, wherein one or both of the first and second Fc regions comprise the following amino acids at the indicated positions (EU numbering): tyrosine at position 252, threonine at position 254 and glutamic acid at position 256 (YTE); or leucine at position 428 and serine at position 434 (LS). In some embodiments, the multi-specific (e.g., bispecific) antigen binding molecules comprise a heterodimeric human IgG1, comprising a first Fc region and a second Fc region, wherein one of the first and second Fc regions comprise the following amino acids at the indicated positions (EU numbering): tyrosine at position 252, threonine at position 254 and glutamic acid at position 256 (YTE). In some embodiments, the multi-specific (e.g., bispecific) antigen binding molecules comprise a heterodimeric human IgG1, comprising a first Fc region and a second Fc region, wherein the second Fc region comprises the following amino acids at the indicated positions (EU numbering): tyrosine at position 252, threonine at position 254 and glutamic acid at position 256 (YTE). In some embodiments, the multi-specific (e.g., bispecific) antigen binding molecules comprise a heterodimeric human IgG1 or IgG4, comprising a first Fc region and a second Fc region, comprising the following amino acids at the indicated positions (EU numbering): the first Fc region comprises a tryptophan at position 366 (T366W); and the second Fc region comprises a serine at position 366 (T366S), an alanine at position 368 (L368A) and a valine at position 407 (Y407V); the first Fc region comprises a serine at position 366 (T366S), an alanine at position 368 (L368A) and a valine at position 407 (Y407V); and the second Fc region comprises a tryptophan at position 366 (T366W); the first Fc region comprises a cysteine at position 354 (S354C), a tryptophan at position 366 (T366W); and the second Fc region comprises a cysteine at position 349 (Y349C), a serine at position 366 (T366S), an alanine at position 368 (L368A) and a valine at position 407 (Y407V); the first Fc region comprises cysteine at position 349 (Y349C), a serine at position 366 (T366S), an alanine at position 368 (L368A) and a valine at position 407 (Y407V); and the second Fc region comprises a cysteine at position 354 (S354C), a tryptophan at position 366 (T366W). In some embodiments, the multi-specific (e.g., bispecific) antigen binding molecules comprise a heterodimeric human IgG1, comprising a first Fc region and a second Fc region, comprising the following amino acids at the indicated positions (EU numbering): the first Fc region comprises a tryptophan at position 366 (T366W); and the second Fc region comprises a serine at position 366 (T366S), an alanine at position 368 (L368A) and a valine at position 407 (Y407V); or the first Fc region comprises a serine at position 366 (T366S), an alanine at position 368 (L368A) and a valine at position 407 (Y407V); and the second Fc region comprises a tryptophan at position 366 (T366W). In some embodiments, the multi-specific (e.g., bispecific) antigen binding molecules comprise a heterodimeric human IgG1, comprising a first Fc region and a second Fc region, comprising the following amino acids at the indicated positions (EU numbering): the first Fc region comprises a serine at position 366 (T366S), an alanine at position 368 (L368A) and a valine at position 407 (Y407V); and the second Fc region comprises a tryptophan at position 366 (T366W). In some embodiments, the multi-specific (e.g., bispecific) antigen binding molecules comprise a heterodimeric human IgG1 or IgG4, comprising a first hinge region and a second hinge region, (C220S) wherein one or both of the first and second hinge regions comprise a serine at position 220 (EU numbering). In some embodiments, the multi-specific (e.g., bispecific) antigen binding and a second molecules comprise a heterodimeric human IgG1 or IgG4, comprising a first Fc region Fc region, wherein one of the first Fc region or the second Fc region comprise the following amino acids at the indicated positions (EU numbering): arginine at position 435 (H435R); or arginine at position 435 (H435R) and phenylalanine at position 436 (Y436F). In some embodiments, the multi-specific (e.g., bispecific) antigen binding molecules comprise a heterodimeric human IgG1, comprising a first Fc region and a second Fc region, wherein one of the first Fc region or the second Fc region comprise the following amino acids at the indicated positions (EU numbering): arginine at position 435 (H435R). In some embodiments, the multi-specific (e.g., bispecific) antigen binding molecules comprise a heterodimeric human IgG1, comprising a first Fc region and a second Fc region, wherein the first Fc region comprises arginine at position 435 (H435R). In some embodiments, the multi-specific (e.g., bispecific) antigen binding molecules comprise a heterodimeric human IgG1 or IgG4, comprising a first Fc region and a second Fc region, comprising the following amino acids at the indicated positions (EU numbering): the first Fc region comprises an alanine at position 234 (L234A), an alanine at position 235 (L235A), a serine at position 331 (P331S) and a tryptophan at position 366 (T366W); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R); the first Fc region comprises an alanine at position 234 (L234A), an alanine at position 235 (L235A), a serine at position 331 (P331S) and a tryptophan at position 366 (T366W); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), an arginine at position 435 (H435R) and a phenylalanine at position 436 (Y436F); the first Fc region comprises an alanine at position 234 (L234A), an alanine at position 235 (L235A), a serine at position 331 (P331S), a serine at position 366 (T366S), an alanine at position 368 (L368A), and a valine at position 407 (Y407V); and the second Fc region comprises an alanine at position 234 (L234A), an alanine at position 235 (L235A), a serine at position 331 (P331S) and a tryptophan at position 366 (T366W); the first Fc region comprises an alanine at position 234 (L234A), an alanine at position 235 (L235A), a serine at position 331 (P331S), a tryptophan at position 366 (T366W), a leucine at position 428 (M428L) and a serine at position 434 (N434S); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R); or the first Fc region comprises an alanine at position 234 (L234A), an alanine at position 235 (L235A), a serine at position 331 (P331S), a tryptophan at position 366 (T366W), a tyrosine at position 252 (M252Y), a threonine at position 254 (S254T) and a glutamic acid at position 256 (T256E); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R). In some embodiments, the multi-specific (e.g., bispecific) antigen binding molecules comprise a heterodimeric human IgG1, comprising a first Fc region and a second Fc region, comprising the following amino acids at the indicated positions (EU numbering): the first Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R); and the second Fc region comprises an alanine at position 234 (L234A), an alanine at position 235 (L235A), a serine at position 331 (P331S), a tryptophan at position 366 (T366W), a tyrosine at position 252 (M252Y), a threonine at position 254 (S254T) and a glutamic acid at position 256 (T256E). In some embodiments, the multi-specific (e.g., bispecific) antigen binding molecules comprise a heterodimeric human IgG1, comprising a first Fc region and a second Fc region, comprising amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs.: 696 and 697; SEQ ID NOs.: 697 and 696; SEQ ID NOs.: 696 and 698; SEQ ID NOs.: 698 and 696; SEQ ID NOs.: 699 and 700; SEQ ID NOs.: 700 and 699; SEQ ID NOs.: 701 and 698; SEQ ID NOs.: 698 and 701; SEQ ID NOs.: 702 and 703; SEQ ID NOs.: 703 and 702; SEQ ID NOs.: 704 and 698; SEQ ID NOs.: 698 and 704; SEQ ID NOs.: 705 and 703; SEQ ID NOs.: 703 and 705; SEQ ID NOs.: 706 and 704; SEQ ID NOs.: 704 and 706; SEQ ID NOs.: 707 and 703; SEQ ID NOs.: 703 and 707; SEQ ID NOs.: 708 and 704; SEQ ID NOs.: 704 and 708; SEQ ID NOs.: 709 and 710; or SEQ ID NOs.: 710 and 709. In some embodiments, the multi-specific (e.g., bispecific) antigen binding molecules comprise a heterodimeric human IgG1, comprising a first Fc region and a second Fc region, comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs.: 703 and 705. In some embodiments, the multi-specific (e.g., bispecific) antigen binding molecules comprise a heterodimeric human IgG1, comprising a first Fc region and a second Fc region, comprising amino acid sequences that are at least 95% identical to the amino acid sequences set forth, respectively: SEQ ID NOs.: 703 and 705. In some embodiments, the multi-specific (e.g., bispecific) antigen binding molecules comprise a heterodimeric human IgG1, comprising a first Fc region and a second Fc region, comprising amino acid sequences that are at least 99% identical to the amino acid sequences set forth, respectively: SEQ ID NOs.: 703 and 705. In some embodiments, the multi-specific (e.g., bispecific) antigen binding molecules comprise a heterodimeric human IgG1, comprising a first Fc region and a second Fc region, comprising amino acid sequences set forth, respectively: SEQ ID NOs.: 703 and 705.

With respect to further embodiments of the multi-specific (e.g., bispecific) antigen binding molecules, in some embodiments, the first antigen binding domain is a scFv that binds to CD3 and the second antigen binding domain is a Fab that binds to HIV gp120, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 806, 801 and 802; SEQ ID NOs: 806, 803 and 802; SEQ ID NOs: 807, 803 and 802; SEQ ID NOs: 807, 805 and 802; SEQ ID NOs: 808, 809 and 802; SEQ ID NOs: 808, 810 and 802; SEQ ID NOs: 811, 801 and 802; SEQ ID NOs: 812, 809 and 802; SEQ ID NOs: 812, 810 and 802; SEQ ID NOs: 813, 805 and 802; SEQ ID NOs: 812, 814 and 802; SEQ ID NOs: 815, 801 and 802; SEQ ID NOs: 816, 805 and 802; SEQ ID NOs: 817, 801 and 802; SEQ ID NOs: 818, 805 and 802; SEQ ID NOs: 819, 810 and 802; SEQ ID NOs: 820, 810 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 830, 822 and 823; SEQ ID NOs: 830, 825 and 823; SEQ ID NOs: 831, 825 and 823; SEQ ID NOs: 831, 827 and 823; SEQ ID NOs: 832, 833 and 823; SEQ ID NOs: 832, 829 and 823; SEQ ID NOs: 834, 827 and 823; SEQ ID NOs: 835, 829 and 823; SEQ ID NOs: 836, 829 and 823; SEQ ID NOs: 837, 833 and 823; SEQ ID NOs: 837, 838 and 823; SEQ ID NOs: 839, 840 and 823; SEQ ID NOs: 841, 829 and 823; SEQ ID NOs: 842, 829 and 823; SEQ ID NOs: 843, 829 and 823; SEQ ID NOs: 844, 829 and 823; SEQ ID NOs: 845, 829 and 823; SEQ ID NOs: 846, 829 and 823; SEQ ID NOs: 846, 833 and 823; SEQ ID NOs: 846, 838 and 823; SEQ ID NOs: 847, 827 and 823; SEQ ID NOs: 848, 829 and 823; SEQ ID NOs: 849, 829 and 823; SEQ ID NOs: 850, 829 and 823; SEQ ID NOs: 851, 829 and 823; SEQ ID NOs: 852, 829 and 823; SEQ ID NOs: 853, 829 and 823; SEQ ID NOs: 854, 829 and 823; SEQ ID NOs: 855, 829 and 823; SEQ ID NOs: 856, 829 and 823; SEQ ID NOs: 857, 829 and 823; SEQ ID NOs: 858, 829 and 823; SEQ ID NOs: 859, 829 and 823; SEQ ID NOs: 860, 829 and 823; SEQ ID NOs: 861, 862 and 863; SEQ ID NOs: 861, 864 and 863; SEQ ID NOs: 865, 864 and 863; SEQ ID NOs: 865, 866 and 863; SEQ ID NOs: 867, 868 and 863; SEQ ID NOs: 869, 862 and 863; SEQ ID NOs: 869, 864 and 863; SEQ ID NOs: 870, 864 and 863; SEQ ID NOs: 870, 866 and 863; SEQ ID NOs: 871, 872 and 863; SEQ ID NOs: 871, 868 and 863; SEQ ID NOs: 873, 862 and 863; SEQ ID NOs: 874, 866 and 863; SEQ ID NOs: 875, 872 and 863; SEQ ID NOs: 875, 868 and 863; SEQ ID NOs: 875, 876 and 863; SEQ ID NOs: 877, 862 and 863; SEQ ID NOs: 878, 866 and 863; SEQ ID NOs: 879, 862 and 863; SEQ ID NOs: 880, 866 and 863; SEQ ID NOs: 881, 882 and 883; SEQ ID NOs: 881, 884 and 883; SEQ ID NOs: 885, 884 and 883; SEQ ID NOs: 885, 886 and 883; SEQ ID NOs: 887, 888 and 883; SEQ ID NOs: 889, 882 and 883; SEQ ID NOs: 889, 884 and 883; SEQ ID NOs: 890, 884 and 883; SEQ ID NOs: 890, 886 and 883; SEQ ID NOs: 891, 892 and 883; SEQ ID NOs: 891, 888 and 883; SEQ ID NOs: 893, 882 and 883; SEQ ID NOs: 894, 886 and 883; SEQ ID NOs: 895, 892 and 883; SEQ ID NOs: 895, 888 and 883; SEQ ID NOs: 895, 896 and 883; SEQ ID NOs: 897, 882 and 883; SEQ ID NOs: 898, 886 and 883; SEQ ID NOs: 899, 882 and 883; or SEQ ID NOs: 900, 886 and 883. In some embodiments, the first antigen binding domain is a scFv that binds to CD3 and the second antigen binding domain is a Fab that binds to HIV gp120, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 806, 801 and 802; SEQ ID NOs: 806, 803 and 802; SEQ ID NOs: 807, 803 and 802; SEQ ID NOs: 807, 805 and 802; SEQ ID NOs: 808, 809 and 802; SEQ ID NOs: 808, 810 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 830, 822 and 823; SEQ ID NOs: 830, 825 and 823; SEQ ID NOs: 831, 825 and 823; SEQ ID NOs: 831, 827 and 823; SEQ ID NOs: 832, 833 and 823; SEQ ID NOs: 832, 829 and 823; SEQ ID NOs: 861, 862 and 863; SEQ ID NOs: 861, 864 and 863; SEQ ID NOs: 865, 864 and 863; SEQ ID NOs: 865, 866 and 863; SEQ ID NOs: 867, 868 and 863; SEQ ID NOs: 869, 862 and 863; SEQ ID NOs: 869, 864 and 863; SEQ ID NOs: 870, 864 and 863; SEQ ID NOs: 870, 866 and 863; SEQ ID NOs: 871, 872 and 863; SEQ ID NOs: 871, 868 and 863; SEQ ID NOs: 881, 882 and 883; SEQ ID NOs: 881, 884 and 883; SEQ ID NOs: 885, 884 and 883; SEQ ID NOs: 885, 886 and 883; SEQ ID NOs: 887, 888 and 883; SEQ ID NOs: 889, 882 and 883; SEQ ID NOs: 889, 884 and 883; SEQ ID NOs: 890, 884 and 883; SEQ ID NOs: 890, 886 and 883; SEQ ID NOs: 891, 892 and 883; or SEQ ID NOs: 891, 888 and 883. In some embodiments, the first antigen binding domain is a scFv that binds to CD3 and the second antigen binding domain is a Fab that binds to HIV gp120, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 861, 862 and 863; SEQ ID NOs: 861, 864 and 863; SEQ ID NOs: 865, 864 and 863; SEQ ID NOs: 865, 866 and 863; SEQ ID NOs: 867, 868 and 863; SEQ ID NOs: 881, 882 and 883; SEQ ID NOs: 881, 884 and 883; SEQ ID NOs: 885, 884 and 883; SEQ ID NOs: 885, 886 and 883; or SEQ ID NOs: 887, 888 and 883. In some embodiments, the first antigen binding domain is a scFv that binds to CD3 and the second antigen binding domain is a Fab that binds to HIV gp120, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 861, 862 and 863; SEQ ID NOs: 861, 864 and 863; SEQ ID NOs: 865, 864 and 863; SEQ ID NOs: 865, 866 and 863; or SEQ ID NOs: 867, 868 and 863.

With respect to further embodiments of the multi-specific (e.g., bispecific) antigen binding molecules, in some embodiments, the multi-specific (e.g., bispecific) antigen binding molecule comprises (a) a first antigen binding domain that comprises a first heavy chain variable domain (VH) and a first light chain variable domain (VL), wherein the first antigen binding domain binds to CD3; and (b) a second antigen binding domain that binds to HIV gp120 comprising one or more extracellular (EC) domain of CD4, wherein the one or more EC domains of CD4 comprise a sequence as set forth below, or a sequence that is at least 80%, at least 85%, at least 90%, at least 91%, at least 92%, at least 93%, at least 94%, at least 95%, at least 96%, at least 97%, at least 98%, or at least 99% identical to a sequence selected from the group consisting of:

(i)
(SEQ ID NO: 746)
KKVVYGKKGDTVELTCTASQKKNIQFHWKNSNQIKILGNQGSFLTKGPSK
LNDRVDSRRSLWDQGNFPLIIKNLKPEDSDTYICEVEDQKEEVQLVVVG;

(ii)
(SEQ ID NO: 747)
KKVVYGKKGDTVELTCTASQKKNIQFHWKNSNQIKILGNQGSFLTKGPSK
LNDRVDSRRSLWDQGNFPLIIKNLKPEDSDTYICEVEDQKEEVQLVVVGG
GGSGKKVVYGKKGDTVELTCTASQKKNIQFHWKNSNQIKILGNQGSFLTK
GPSKLNDRVDSRRSLWDQGNFPLIIKNLKPEDSDTYICEVEDQKEEVQLV
VVG;

(iii)
(SEQ ID NO: 748)
KKVVLGKKGDTVELTCTASQKKSIQFHWKNSNQIKILGNQGSFLTKGPSK
LNDRADSRRSLWDQGNFPLIIKNLKIEDSDTYICEVEDQKEEVQLLVFG;
or (iv)
(SEQ ID NO: 749)
KKVVLGKKGDTVELTCTASQKKSIQFHWKNSNQIKILGNQGSFLTKGPSK
LNDRADSRRSLWDQGNFPLIIKNLKIEDSDTYICEVEDQKEEVQLLVFGG
GGSGKKVVLGKKGDTVELTCTASQKKSIQFHWKNSNQIKILGNQGSFLTK
GPSKLNDRADSRRSLWDQGNFPLIIKNLKIEDSDTYICEVEDQKEEVQLL
VFG.

In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO:746. In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746. In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 50 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain is a Fab that binds to CD3 and the second antigen binding domain is a scFv or an EC domain of CD4 that binds to HIV gp120, wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; SEQ ID NOs: 754, 752 and 753; SEQ ID NOs: 755, 756 and 753; SEQ ID NOs: 755, 757 and 753; SEQ ID NOs: 758, 757 and 753; SEQ ID NOs: 759, 756 and 753; SEQ ID NOs: 754, 760 and 761; SEQ ID NOs: 762, 760 and 761; SEQ ID NOs: 751, 763 and 753; SEQ ID NOs: 764, 752 and 753; SEQ ID NOs: 765, 752 and 753; SEQ ID NOs: 766, 767 and 753; SEQ ID NOs: 766, 768 and 753; SEQ ID NOs: 769, 768 and 753; SEQ ID NOs: 770, 767 and 753; SEQ ID NOs: 765, 771 and 761; SEQ ID NOs: 772, 771 and 761; SEQ ID NOs: 774, 775 and 776; SEQ ID NOs: 777, 778 and 776; SEQ ID NOs: 779, 778 and 776; SEQ ID NOs: 779, 780 and 776; SEQ ID NOs: 777, 781 and 776; SEQ ID NOs: 782, 752 and 753; SEQ ID NOs: 783, 752 and 753; SEQ ID NOs: 784, 785 and 753; SEQ ID NOs: 784, 786 and 753; SEQ ID NOs: 787, 786 and 753; SEQ ID NOs: 788, 785 and 753; SEQ ID NOs: 783, 789 and 761; SEQ ID NOs: 790, 789 and 761; SEQ ID NOs: 792, 793 and 794; SEQ ID NOs: 795, 796 and 794; SEQ ID NOs: 797, 796 and 794; SEQ ID NOs: 797, 798 and 794; or SEQ ID NOs: 795, 799 and 794. In some embodiments, the first antigen binding domain is a Fab that binds to CD3 and the second antigen binding domain is a scFv or an EC domain of CD4 that binds to HIV gp120, wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; SEQ ID NOs: 754, 752 and 753; SEQ ID NOs: 755, 756 and 753; SEQ ID NOs: 755, 757 and 753; SEQ ID NOs: 758, 757 and 753; or SEQ ID NOs: 759, 756 and 753. In some embodiments, the first antigen binding domain is a Fab that binds to CD3 and the second antigen binding domain is a scFv or an EC domain of CD4 that binds to HIV gp120, wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; or SEQ ID NOs: 755, 756 and 753. In some embodiments, the first antigen binding domain is a Fab that binds to CD3 and the second antigen binding domain is a scFv or an EC domain of CD4 that binds to HIV gp120, wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753. In some embodiments, the first antigen binding domain is a Fab that binds to CD3 and the second antigen binding domain is a scFv or an EC domain of CD4 that binds to HIV gp120, wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 755, 756 and 753.

With respect to further embodiments of the multi-specific (e.g., bispecific) antigen binding molecules, in some embodiments, the multi-specific antigen binding molecule is a bispecific antigen binding molecule. In some embodiments, the multi-specific antigen binding molecule binds to or targets human CD3 and HIV gp120. In some embodiments, the first VH and the first VL have at least 80%, 81%, 82%, 83%, 84%, 85%, or more, sequence similarity to a human germline VH and a human germline VL, respectively. In some embodiments, the first antigen binding domain has reduced or insignificant or substantially no binding to Protein A, or does not detectably bind to Protein A. In some embodiments, the first antigen binding domain binds to Protein A with a binding equilibrium dissociation constant ($K_D$) of greater than $10^{-6}$ M. In some embodiments, the first antigen binding domain binds to CD3 with a $K_D$ of lower than 10 nM, e.g., lower than 9.5 nM, 9.0 nM, 8.5 nM, 8.0 nM, 7.5 nM, 7.0 nM, 6.5 nM, 6.0 nM, 5.5 nM, 5.0 nM, 4.5 nM, 4.0 nM, 3.5 nM, 3.0 nM, or lower. In some embodiments, the first antigen binding domain binds to CD3 with a $K_D$ of lower than 3.0 nM (e.g., 2.5 nM). In some embodiments, the multi-specific (e.g., bispecific) antigen binding molecule has a serum half-life in a human or cynomolgus monkey of at least 3 days, e.g., at least 4 days, at least 5 days, at least 6 days, at least 7 days, at least 8 days, at least 9 days, at least 10 days, at least 11 days, at least 12 days, at least 13 days, at least 14 days, at least 15 days, at least 16 days, or longer. In some embodiments, the multi-specific (e.g., bispecific) antigen binding molecule has a serum half-life in a human or cynomolgus monkey of at least 7 days. In some embodiments, the multi-specific (e.g., bispecific) antigen binding molecule has a serum half-life in a human of at least 7 days. In some embodiments, the first antigen binding domain binds to CD3 with a $K_D$ of lower than 7.0 nM, e.g., lower than 6.5 nM, 6.0 nM, 5.5 nM, 5.0 nM, 4.5 nM, 4.0 nM, 3.5 nM, 3.0 nM, or lower, and the multi-specific (e.g., bispecific) antigen binding molecule has a serum half-life in a human or cynomolgus monkey of at least at least 5 days, e.g., at least 5.5 days, at least 6 days, at least 6.5 days, at least 7 days, at least 7.5 days, at least 8 days, at least 8.5 days, at least 9 days, at least 10 days, at least 11 days, at least 12 days, at least 13 days, at least 14 days, or longer. In some embodiments, the first antigen binding domain binds to CD3 with a $K_D$ of lower than 3.0 nM (e.g., 2.5 nM), and the multi-specific (e.g., bispecific) antigen binding molecule has a serum half-life in a human or cynomolgus monkey of at least 7 days. In some embodiments, the first antigen binding domain binds to CD3 with a $K_D$ of lower than 3.0 nM (e.g., 2.5 nM), and the multi-specific (e.g., bispecific) antigen binding molecule has a serum half-life in a human of at least 7 days. In some embodiments, at least 50%, at least 60%, at least 70%, least 80%, at least 85%, at least 90%, or more, N-linked glycosylation sites in at least one of the first VH, the first VL, the second VH and the second VL are sialylated. In some embodiments, the N-linked glycosylation sites in at least one of the first VH, the first VL, the second VH and the second VL have a sialic acid occupancy (e.g., a glycan comprising one or two terminal sialic acid residues) of at least 40%, at least 50%, at least 60%, at least 70%, at least 80%, at least 85%, at least 90%, or more. In some embodiments, the sialylated N-linked glycosylation sites in at least one of the first VH, the first VL, the second VH and the second VL comprise from 1 to 5 sialic acid residues, e.g., from 1 to 4 sialic acid residues, e.g., from 1 to 3 sialic acid residues, e.g., from 1 to 2 sialic acid residues. In some embodiments, at least one of the first VH, the first VL, the second VH and the second VL are sialylated with N-acetylneuraminic acid (NANA). In some embodiments, the sialic acid residues are present in biantennary structures. In some embodiments, the sialic acid residues are present in complex N-linked glycan structures. In some embodiments, the sialic acid residues are present in hybrid N-linked glycan structures. In some embodiments, the glycans are terminally sialylated.

In another aspect, provided is a polynucleotide or multiple polynucleotides encoding at least the first VH and the first VL of the multi-specific (e.g., bispecific) antigen binding molecule, as described herein. In some embodiments, the polynucleotide or polynucleotides, further comprise a polynucleotide or multiple polynucleotides encoding the second VH and the second VL of the multi-specific (e.g., bispecific) antigen binding molecule, as described herein. In some embodiments, the polynucleotide or polynucleotides comprise a polynucleotide or multiple polynucleotides encoding the HC of the first antigen binding domain that is an scFv, and the HC and LC of the second antigen binding domain that is a Fab, of the multi-specific (e.g., bispecific) antigen binding molecule, as described herein. In some embodiments, the polynucleotide or polynucleotides comprise a polynucleotide or multiple polynucleotides encoding the HC and LC of the first antigen binding domain that is a Fab, and the HC of the second antigen binding domain that is an scFv or an EC domain of CD4, of the multi-specific (e.g., bispecific) antigen binding molecule. In some embodiments, the polynucleotide or polynucleotides comprise a polynucleotide or multiple polynucleotides encoding the HC and LC of the first antigen binding domain that is a Fab, and the HC of the second antigen binding domain that is an EC domain of CD4, of the multi-specific (e.g., bispecific) antigen binding molecule. In some embodiments, the polynucleotide or polynucleotides encode a multi-specific antigen binding molecule, as described herein, comprising the following polynucleotide sequences, or polynucleotide sequences that are at least 80%, at least 85%, at least 90%, at least 91%, at least 92%, at least 93%, at least 94%, at least 95%, at least 96%, at least 97%, at least 98%, or at least 99% identical to the polynucleotide sequences set forth, respectively: SEQ ID NOs: 995, 996 and 997; SEQ ID NOs: 998, 999 and 1000; SEQ ID NOs: 1001, 1002 and 1003; SEQ ID NOs: 1004, 1005 and 1000; SEQ ID NOs: 1006, 1002 and 997; SEQ ID NOs: 1007, 1093 and 1000; SEQ ID NOs: 998, 1008 and 1000; SEQ ID NOs: 998, 1009 and 1000; SEQ ID NOs: 1010, 1011 and 1012; SEQ ID NOs: 1013, 1014 and 1015; SEQ ID NOs: 1016, 1017 and 1012; SEQ ID NOs: 1018, 1019 and 1012; SEQ ID NOs: 1018, 1020 and 1012; SEQ ID NOs: 1021, 1022 and 1023; or SEQ ID NOs: 1024, 1025 and 1023. In some embodiments, the polynucleotide or polynucleotides encode a multi-specific antigen binding molecule, as described herein, comprising polynucleotide sequences that are at least 80%, at least 85%, at least 90%, at least 91%, at least 92%, at least 93%, at least 94%, at least 95%, at least 96%, at least 97%, at least 98%, or at least 99% identical to the polynucleotide sequences set forth, respectively: SEQ ID NOs: 995, 996 and 997. In some embodiments, the polynucleotide or polynucleotides encode a multi-specific antigen binding molecule, as described herein, comprising polynucleotide sequences that are at least 95% (e.g., at least 96%, at least 97%, at least 98%, or at least 99%) identical to the polynucleotide sequences set forth: SEQ ID NOs: 995, 996 and 997. In some embodiments, the polynucleotide or polynucleotides encode a multi-specific antigen binding molecule, as described herein, comprising the following polynucleotide sequences: SEQ ID NOs: 995, 996 and 997. In some embodiments, the polynucleotide or polynucleotides encode a multi-specific antigen binding molecule, as described herein, comprising polynucleotide sequences that are at least 80%, at least 85%, at least 90%, at least 91%, at least 92%, at least 93%, at least 94%, at least 95%, at least 96%, at least 97%, at least 98%, or at least 99% identical to the polynucleotide sequences set forth, respectively: SEQ ID NOs: 998, 999 and 1000. In some embodiments, the polynucleotide or polynucleotides encode a multi-specific antigen binding molecule, as described herein, comprising polynucleotide sequences that are at least 95% (e.g., at least 96%, at least 97%, at least 98%, or at least 99%) identical to the polynucleotide sequences set forth: SEQ ID NOs: 998, 999 and 1000. In some embodiments, the polynucleotide or polynucleotides encode a multi-specific antigen binding molecule, as described herein, comprising the following polynucleotide sequences: SEQ ID NOs: 998, 999 and 1000. In some embodiments, the polynucleotide or polynucleotides are comprised of DNA or RNA. In some embodiments, the polynucleotide or polynucleotides are comprised of mRNA. In some embodiments, the polynucleotide or polynucleotides comprise codon bias for efficient expression in a human cell. In a further aspect, provided is a lipoplex, e.g., a lipid nanoparticle (LNP), comprising the polynucleotide or polynucleotides, as described herein. In a further aspect, provided is an expression cassette or multiple expression cassettes comprising one or more regulatory sequences operably linked to the polynucleotide or polynucleotides, as described herein.

In a further aspect, provided is an expression vector or multiple expression vectors comprising one or more regulatory sequences operably linked to the polynucleotide or polynucleotides, or the expression cassette or expression cassettes, as described herein. In some embodiments, the expression vector or expression vectors comprise a plasmid vector or a viral vector. In some embodiments, the expression vector comprises three, four or five expression cassettes or cistrons. In some embodiments, the expression vector comprises, optionally in sequential order from 5' to 3': (i) a first expression cassette or cistron comprising a first polynucleotide encoding an anti-HIV gp120 VL-light chain constant domain (CL) fusion protein; (ii) a second expression cassette or cistron comprising a second polynucleotide encoding an anti-HIV gp120 VH-Fc fusion protein; and (iii) a third expression cassette or cistron comprising a third polynucleotide encoding an anti-CD3 scFv-Fc fusion protein. In some embodiments, the anti-HIV gp120 VL-CL fusion protein, the anti-HIV gp120 VH-Fc fusion protein and the anti-CD3 scFv-Fc fusion protein comprise amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 802, 801 and 800; SEQ ID NOs: 802, 803 and 800; SEQ ID NOs: 802, 803 and 804; SEQ ID NOs: 802, 805 and 804; SEQ ID NOs: 802, 801 and 806; SEQ ID NOs: 802, 803 and 806; SEQ ID NOs: 802, 803 and 807; SEQ ID NOs: 802, 805 and 807; SEQ ID NOs: 802, 809 and 808; SEQ ID NOs: 802, 810 and 808; SEQ ID NOs: 802, 801 and 811; SEQ ID NOs: 802, 809 and 812; SEQ ID NOs: 802, 810 and 812; SEQ ID NOs: 802, 805 and 813; SEQ ID NOs: 802, 814 and 812; SEQ ID NOs: 802, 801 and 815; SEQ ID NOs: 802, 805 and 816; SEQ ID NOs: 802, 801 and 817; SEQ ID NOs: 802, 805 and 818; SEQ ID NOs: 802, 810 and 819; SEQ ID NOs: 802, 810 and 820; SEQ ID NOs: 823, 822 and 821; SEQ ID NOs: 823, 825 and 824; SEQ ID NOs: 823, 825 and 826; SEQ ID NOs: 823, 827 and 826; SEQ ID NOs: 823, 829 and 828; SEQ ID NOs: 823, 822 and 830; SEQ ID NOs: 823, 825 and 830; SEQ ID NOs: 823, 825 and 831; SEQ ID NOs: 823, 827 and 831; SEQ ID NOs: 823, 833 and 832; SEQ ID NOs: 823, 829 and 832; SEQ ID NOs: 823, 827 and 834; SEQ ID NOs: 823, 829 and 835; SEQ ID NOs: 823, 829 and 836; SEQ ID NOs: 823, 833 and 837; SEQ ID NOs: 823, 838 and 837; SEQ ID NOs: 823, 840 and 839; SEQ ID NOs: 823, 829 and 841; SEQ ID NOs: 823, 829 and 842; SEQ ID NOs: 823, 829 and 843; SEQ ID NOs: 823, 829 and 844; SEQ ID NOs: 823, 829 and 845; SEQ ID NOs: 823, 829 and 846; SEQ ID NOs: 823, 833 and 846; SEQ ID NOs: 823, 838 and 846; SEQ ID NOs: 823, 827 and 847; SEQ ID NOs: 823, 829 and 848; SEQ ID NOs: 823, 829 and 849; SEQ ID NOs: 823, 829 and 850; SEQ ID NOs: 823, 829 and 851; SEQ ID NOs: 823, 829 and 852; SEQ ID NOs: 823, 829 and 853; SEQ ID NOs: 823, 829 and 854; SEQ ID NOs: 823, 829 and 855; SEQ ID NOs: 823, 829 and 856; SEQ ID NOs: 823, 829 and 857; SEQ ID NOs: 823, 829 and 858; SEQ ID NOs: 823, 829 and 859; SEQ ID NOs: 823, 829 and 860; SEQ ID NOs: 863, 862 and 861; SEQ ID NOs: 863, 864 and 861; SEQ ID NOs: 863, 864 and 865; SEQ ID NOs: 863, 866 and 865; SEQ ID NOs: 863, 868 and 867; SEQ ID NOs: 863, 862 and 869; SEQ ID NOs: 863, 864 and 869; SEQ ID NOs: 863, 864 and 870; SEQ ID NOs: 863, 866 and 870; SEQ ID NOs: 863, 872 and 871; SEQ ID NOs: 863, 868 and 871; SEQ ID NOs: 863, 862 and 873; SEQ ID NOs: 863, 866 and 874; SEQ ID NOs: 863, 872 and 875; SEQ ID NOs: 863, 868 and 875; SEQ ID NOs: 863, 876 and 875; SEQ ID NOs: 863, 862 and 877; SEQ ID NOs: 863, 866 and 878; SEQ ID NOs: 863, 862 and 879; SEQ ID NOs: 863, 866 and 880; SEQ ID NOs: 883, 882 and 881; SEQ ID NOs: 883, 884 and 881; SEQ ID NOs: 883, 884 and 885; SEQ ID NOs: 883, 886 and 885; SEQ ID NOs: 883, 888 and 887; SEQ ID NOs: 883, 882 and 889; SEQ ID NOs: 883, 884 and 889; SEQ ID NOs: 883, 884 and 890; SEQ ID NOs: 883, 886 and 890; SEQ ID NOs: 883, 892 and 891; SEQ ID NOs: 883, 888 and 891; SEQ ID NOs: 883, 882 and 893; SEQ ID NOs: 883, 886 and 894; SEQ ID NOs: 883, 892 and 895; SEQ ID NOs: 883, 888 and 895; SEQ ID NOs: 883, 896 and 895; SEQ ID NOs: 883, 882 and 897; SEQ ID NOs: 883, 886 and 898; SEQ ID NOs: 883, 882 and 899; or SEQ ID NOs: 883, 886 and 900. In some embodiments, the expression vector comprises, optionally in sequential order from 5' to 3': (i) a first expression cassette or cistron comprising a first polynucleotide encoding an anti-CD3 VL-CL fusion protein; (ii) a second expression cassette or cistron comprising a second polynucleotide encoding an anti-CD3 VH-Fc fusion protein; and (iii) a third expression cassette or cistron comprising a third polynucleotide encoding a CD4 extracellular (EC) domain-Fc fusion protein. In some embodiments, the anti-CD3 VL-CL fusion protein, the anti-CD3 VH-Fc fusion protein and the CD4 EC domain-Fc fusion protein comprise amino acid sequences set forth, respectively, below, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively, below: SEQ ID NOs: 753, 752 and 751; SEQ ID NOs: 753, 752 and 754; SEQ ID NOs: 753, 756 and 755; SEQ ID NOs: 753, 757 and 755; SEQ ID NOs: 753, 757 and 758; SEQ ID NOs: 753, 756 and 759; SEQ ID NOs: 761, 760 and 754; SEQ ID NOs: 761, 760 and 762; SEQ ID NOs: 753, 763 and 751; SEQ ID NOs: 753, 752 and 764; SEQ ID NOs: 753, 752 and 765; SEQ ID NOs: 753, 767 and 766; SEQ ID NOs: 753, 768 and 766; SEQ ID NOs: 753, 768 and 769; SEQ ID NOs: 753, 767 and 770; SEQ ID NOs: 761, 771 and 765; SEQ ID NOs: 761, 771 and 772; SEQ ID NOs: 776, 775 and 774; SEQ ID NOs: 776, 778 and 777; SEQ ID NOs: 776, 778 and 779; SEQ ID NOs: 776, 780 and 779; SEQ ID NOs: 776, 781 and 777; SEQ ID NOs: 753, 752 and 782; SEQ ID NOs: 753, 752 and 783; SEQ ID NOs: 753, 785 and 784;

SEQ ID NOs: 753, 786 and 784; SEQ ID NOs: 753, 786 and 787; SEQ ID NOs: 753, 785 and 788; SEQ ID NOs: 761, 789 and 783; SEQ ID NOs: 761, 789 and 790; SEQ ID NOs: 794, 793 and 792; SEQ ID NOs: 794, 796 and 795; SEQ ID NOs: 794, 796 and 797; SEQ ID NOs: 794, 798 and 797; or SEQ ID NOs: 794, 799 and 795. In some embodiments, the anti-CD3 VL-CL fusion protein, the anti-CD3 VH-Fc fusion protein and the CD4 EC domain-Fc fusion protein comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 753, 752 and 751. In some embodiments, the anti-CD3 VL-CL fusion protein, the anti-CD3 VH-Fc fusion protein and the CD4 EC domain-Fc fusion protein comprise amino acid sequences set forth, respectively: SEQ ID NOs: 753, 752 and 751. In some embodiments, the first, second and third expression cassettes or cistrons each comprise a promoter of identical or equivalent transcription strength, e.g., a constitutive promoter, e.g., a promoter selected from cytomegalovirus (CMV), SV40, RSV, EF1a, UBC, PGK and CAGG. In some embodiments, the first, second and third expression cassettes or cistrons comprise one or more promoters of different transcription strength. In embodiments, the expression vector further comprises a fourth expression cassette or cistron positioned 5' to the first expression cassette or cistron comprising a polynucleotide encoding a eukaryotic selection marker protein, e.g., glutamine synthetase (GS). Generally, the fourth expression cassette or cistron, positioned 5' to the first expression cassette and comprising a polynucleotide encoding a eukaryotic selection marker protein, is translated from the same strand as the first, second and third expression cassettes or cistrons.

In a further aspect, provided is a cell or population of cells. In various embodiments, the cell or population of cells comprise the polynucleotide or polynucleotides of, the expression cassette or multiple expression cassettes, or the expression vector or expression vectors, as described herein. In some embodiments, the cell or population of cells comprises a eukaryotic cell. In some embodiments, the cell or population of cells comprises a mammalian cell, an insect cell, a plant cell or a yeast cell. In some embodiments, the mammalian cell is a Chinese Hamster Ovary (CHO) cell. In some embodiments, the mammalian cell is a human cell. In some embodiments, the cell is a human embryonic kidney cell. In some embodiments, the cell predominantly sialylates N-linked glycosylation sites in the variable domains (Fv) of expressed antigen binding molecules. In some embodiments, at least 50%, at least 80%, at least 85%, at least 90%, at least 91%, at least 92%, at least 93%, at least 94%, at least 95%, or more, N-linked glycosylation sites in the variable domains (Fv) of expressed antigen binding molecules are sialylated.

In a further aspect, provided is a pharmaceutical composition comprising one or more multi-specific antigen binding molecules, as described herein, and a pharmaceutically acceptable carrier. In a related aspect, provided is a pharmaceutical composition comprising one or more polynucleotides, described herein, encoding one or more multi-specific antigen binding molecule, described herein, or the lipoplex (e.g., LNP) described herein, and a pharmaceutically acceptable carrier. In some embodiments, the pharmaceutical composition comprises an aqueous formulation. In some embodiments, the pharmaceutical composition comprises one or more multi-specific antigen binding molecules, described herein, at a concentration of from 0.1 mg/ml to 150 mg/ml, e.g., from 0.1 mg/ml to 100 mg/ml, e.g., from 1 mg/ml to 100 mg/ml, e.g., from 5 mg/ml to 60 mg/ml, e.g., from 20 mg/ml to 150 mg/ml, or from 10 mg/ml to 50 mg/ml. In some embodiments, the pharmaceutical composition is lyophilized. In some embodiments, the pharmaceutical composition is formulated for intravenous, intramuscular or subcutaneous administration. In some embodiments, the pharmaceutical composition further comprises a second agent for treating an HIV infection. In some embodiments, the pharmaceutical composition further comprises a toll-like receptor (TLR) agonist or an IL-15 receptor agonist. In some embodiments, the pharmaceutical composition comprises a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO: 746. In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the TLR agonist is a TLR2 agonist, a TLR3 agonist, a TLR7 agonist, a TLR8 agonist or a TLR9 agonist. In some embodiments, the pharmaceutical composition further comprises the TLR7 agonist is selected from the group consisting of vesatolimod, imiquimod, and resiquimod. In some embodiments, the pharmaceutical composition comprises a first multi-specific antigen binding molecule and second or additional antigen binding molecules, wherein the first multi-specific antigen binding molecule and the second or additional antigen binding molecules bind to different epitopes or regions of gp120 selected from the group consisting of: (i) the third variable loop (V3) (e.g., high mannose patch) comprising a N332 oligomannose glycan; (ii) the second variable loop (V2) (e.g., Env trimer apex); (iii) the CD4 binding site (CD4bs); (iv) the gp120/gp41 interface; or (v) the silent face of gp120. In some embodiments, the first multi-specific antigen binding molecule binds to the third variable loop (V3) (e.g., high mannose patch) comprising a N332 oligomannose glycan and the second or additional antigen binding molecules bind to the CD4 binding site (CD4bs). In some embodiments, the first multi-specific antigen binding molecule competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second or additional antigen binding molecules compete with or comprise VH and VL regions from an antibody selected from the group consisting of GS-9723, GS-5423, 3BNC117, VRC07 and VRC07-523. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second or additional antigen binding molecules comprise an EC domain of CD4. In some embodiments, the first multi-specific antigen binding molecule binds to the CD4 binding site (CD4bs) and the second or additional antigen binding molecules bind to the third variable loop (V3) (e.g., high mannose patch) comprising a N332 oligomannose glycan. In some embodiments, the first multi-specific antigen binding molecule competes with or comprises VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of GS-9723, GS-5423, 3BNC117, VRC07 and VRC07-523, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the first multi-specific antigen binding molecule competes with or comprises an EC domain of CD4, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises an EC domain of CD4, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the pharmaceutical composition further comprises additional antigen binding molecules that compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the pharmaceutical composition further comprises additional antigen binding molecules that compete with or comprise VH and VL regions from an antibody selected from the group consisting of GS-9723, GS-5423, 3BNC117, VRC07 and VRC07-523. In some embodiments, the pharmaceutical composition comprises: (i) a multi-specific (e.g. bispecific) antigen binding molecule comprising a EC domain of CD4, as described herein; (ii) an antibody or multi-specific antigen binding molecule that competes with or comprises VH and VL regions from an antibody selected from the group consisting of 10-1074, 10-1074-J, GS-9722 (elipovimab), GS-2872, PGT-121, PGT-121.66, PGT-121.414 and PGT-134; and (iii) an antibody or multi-specific antigen binding molecule that competes with or comprises VH and VL regions from an antibody selected from the group consisting of GS-9723, GS-5423, 3BNC117, VRC07 and VRC07-523. In some embodiments, the pharmaceutical composition comprises an additional multi-specific antigen binding molecule that competes with or comprises VH and VL regions from an antibody that binds to the gp120 second variable loop (V2)

(e.g., Env trimer apex). In some embodiments, the pharmaceutical composition comprises an additional multi-specific antigen binding molecule that competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. In some embodiments, the pharmaceutical composition comprises an additional multi-specific antigen binding molecule that competes with or comprises VH and VL regions from an antibody that binds to the gp120/gp41 interface. In some embodiments, the pharmaceutical composition comprises an additional multi-specific antigen binding molecule that competes with or comprises VH and VL regions from an antibody selected from the group consisting of PGT-151, CAP248-2B, 35O22, 8ANC195, ACS202, VRC34 and VRC34.01. In some embodiments, the pharmaceutical composition comprises an additional multi-specific antigen binding molecule that competes with or comprises VH and VL regions from an antibody that binds to an epitope or region of gp41 in the membrane proximal region (MPER). In some embodiments, the pharmaceutical composition comprises an additional multi-specific antigen binding molecule that competes with or comprises VH and VL regions from an antibody selected from the group consisting of 10E8, 10E8v4, 10E8-5R-100cF, 4E10, DH511.11P, 2F5, 7b2, and LN01. In some embodiments, the pharmaceutical composition comprises an additional antigen binding molecule or antigen binding fragment thereof that at least one of binds, inhibits, and neutralizes HIV, or a polynucleotide encoding the additional antigen binding molecule or antigen binding fragment thereof, wherein the additional antigen binding molecule or antigen binding fragment does not compete for binding to gp120 with the one or more multi-specific antigen binding molecules.

In a further aspect, provided is a kit comprising one or more containers comprising one or more of the multi-specific (e.g., bispecific) antigen binding molecules, the polynucleotide or polynucleotides, the lipoplex (e.g., LNP), or the pharmaceutical composition, as described herein. In some embodiments, the kit comprises one or more unitary doses of the one or more multi-specific antigen binding molecules, or the polynucleotide or polynucleotides, in one or more containers (e.g., one or more vials, ampules, syringes). In some embodiments, the kit comprises one or more unitary doses of the one or more multi-specific antigen binding molecules and a second agent for treating an HIV infection in separate containers. In some embodiments, the kit further comprises at least one of a toll-like receptor (TLR) agonist and an IL-15 receptor agonist. In some embodiments, the kit comprises a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749 (e.g., SEQ ID NO: 746), or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs:

50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the TLR agonist is a TLR2 agonist, a TLR3 agonist, a TLR7 agonist, a TLR8 agonist or a TLR9 agonist. In some embodiments, the TLR7 agonist is selected from the group consisting of vesatolimod, imiquimod, and resiquimod. In some embodiments, the kit comprises a first multi-specific antigen binding molecule and second or additional antigen binding molecules, wherein the first multi-specific antigen binding molecule and the second or additional antigen binding molecules bind to different epitopes or regions of gp120 selected from the group consisting of: (i) the third variable loop (V3) (e.g., high mannose patch) comprising a N332 oligomannose glycan; (ii) the second variable loop (V2) (e.g., Env trimer apex); (iii) the CD4 binding site (CD4bs); (iv) the gp120/gp41 interface; or (v) the silent face of gp120. In some embodiments, the first multi-specific antigen binding molecule binds to the third variable loop (V3) (e.g., high mannose patch) comprising a N332 oligomannose glycan and the second or additional antigen binding molecules bind to the CD4 binding site (CD4bs). In some embodiments, the first multi-specific antigen binding molecule competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second or additional antigen binding molecules compete with or comprise VH and VL regions from an antibody selected from the group consisting of GS-9723, GS-5423, 3BNC117, VRC07 and VRC07-523. In some embodiments, the first multi-specific antigen binding molecule competes with or comprises VH and VL regions from an antibody selected from the group consisting of 10-1074, 10-1074-J, GS-9722 and PGT-121, and the second or additional antigen binding molecules comprise an EC domain of CD4. In some embodiments, the first multi-specific antigen binding molecule binds to the CD4 binding site (CD4bs) and the second or additional antigen binding molecules bind to the third variable loop (V3) (e.g., high mannose patch) comprising a N332 oligomannose glycan. In some embodiments, the first multi-specific antigen binding molecule competes with or comprises VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of GS-9723, GS-5423, 3BNC117, VRC07 and VRC07-523, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the first multi-specific antigen binding molecule competes with or comprises an EC domain of CD4, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises an EC domain of CD4, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the kits further comprise second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the kits further comprise second or additional antigen binding molecules compete with or comprise VH and VL regions from an antibody selected from the group consisting of GS-9723, GS-5423, 3BNC117, VRC07 and VRC07-523. In some embodiments, the kit comprises: (i) a multi-specific antigen binding molecule comprising a EC domain of CD4, described herein; (ii) an antibody or multi-specific antigen binding molecule that competes with or comprises VH and VL regions from an antibody selected from the group consisting of 10-1074, 10-1074-J, GS-9722 (elipovimab), GS-2872, PGT-121, PGT-121.66, PGT-121.414 and PGT-134; and (iii) an antibody or multi-specific antigen binding molecule that competes with or comprises VH and VL regions from an antibody selected from the group consisting of GS-9723, GS-5423, 3BNC117, VRC07 and VRC07-523. In some embodiments, the kit comprises two or more unitary doses, wherein the unitary doses are the same or different.

In a further aspect, provided are methods of producing a multi-specific (e.g., bispecific) antigen binding molecule, described herein. In some embodiments, the methods of producing comprises: (a) culturing a cell or population of cells, described herein, transformed with the polynucleotide or polynucleotides, described herein, or the expression cassette or multiple expression cassettes, described herein, in a cell culture under conditions sufficient to express the multi-specific antigen binding molecules; and (b) isolating or purifying the antigen binding molecules from the cell culture. In some embodiments, the first antigen binding domain is a scFv and the second antigen binding domain is a Fab. In some embodiments, the first antigen binding domain is a Fab and the second antigen binding domain is a Fab or an EC domain of CD4. In some embodiments, the first antigen binding domain is a Fab and the second antigen binding domain is an EC domain of CD4. In some embodiments, the polypeptide comprising the first antigen binding domain and the polypeptide comprising the second antigen binding domain are expressed and assembled in the same cell. In some embodiments, the isolating or purifying step comprises Protein A affinity chromatography. In some embodiments, at least 90%, 91%, 92%, 93%, 94%, 95%, 96%, 97%, 98%, 99%, or more, of the multi-specific antigen binding molecules are isolated or purified. In some embodiments, the isolating or purifying step further comprises ion exchange chromatography. In some embodiments, at least 95%, 96%, 97%, 98%, 99%, or more, of the multi-specific antigen binding molecules are isolated or purified. In some embodiments, at least 95%, 96%, 97%, 98%, 99%, or more, of the multi-specific antigen binding molecules isolate or purify as non-aggregated soluble heterodimer as determined using size exclusion chromatography (SEC). In some embodiments, the isolated or purified multi-specific antigen binding molecules have increased homogeneity as assessed by analytical ion exchange chromatography, wherein the integrated area of a main peak representing an unmodified target species is at least 95%, 96%, 97%, 98%, or more, of the sum of all integrated protein peak areas. In some embodiments, the isolated or purified antigen binding molecules have fewer than 35%, 30%, 25%, 20%, 15%, 10%, 9%, 8%, 7%, or fewer, acidic contaminants. In some embodiments, the cell or population of cells are cultured in a culture volume of at least 2 L, e.g., at least 5 L, 10 L, 50 L, 100 L, 150 L, 200 L, 250 L, or more. In some embodiments, the methods further comprise formulating the antigen binding molecule into a sterile pharmaceutical composition suitable for administration to a human subject.

In another aspect, provided are methods of treating or preventing HIV in a human subject in need thereof. In some embodiments, the methods comprise administering to the subject an effective amount of one or more multi-specific (e.g., bispecific) antigen binding molecules, described herein, or the pharmaceutical composition, described herein. In a related aspect, provided are methods of preventing or treating an HIV infection or an HIV-related disease. In some embodiments, the methods comprises the steps of: identifying a patient in need of such prevention or treatment, and administering to said patient a first therapeutic agent comprising a therapeutically effective amount of at least one multi-specific (e.g., bispecific) antigen binding molecules, described herein, or the pharmaceutical composition, described herein. In some embodiments, the methods further comprise administering to the subject a second agent for treating an HIV infection. In some embodiments, the subject is not receiving antiretroviral therapy (ART) or ART is discontinued prior to administration of the one or more multi-specific antigen binding molecules. In some embodiments, ART is discontinued after one or more administrations of the one or more multi-specific antigen binding molecules. In some embodiments, the methods further comprise administering one or more antiretroviral therapy (ART) agents to the subject. In some embodiments, the methods further comprise administering to the subject at least one of a TLR agonist and an IL-15 receptor agonist. In some embodiments, the method comprises administering a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749 (e.g., SEQ ID NO: 746), or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT):

SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the TLR agonist is a TLR2 agonist, a TLR3 agonist, a TLR7 agonist, a TLR8 agonist or a TLR9 agonist. In some embodiments, the TLR7 agonist is selected from the group consisting of vesatolimod, imiquimod, and resiquimod. In some embodiments, the method comprises administering a first multi-specific antigen binding molecule and second or additional antigen binding molecules, wherein the first multi-specific antigen binding molecule and the second or additional antigen binding molecules bind to different epitopes or regions of gp120 selected from the group consisting of: (i) the third variable loop (V3) (e.g., high mannose patch) comprising a N332 oligomannose glycan; (ii) the second variable loop (V2) (e.g., Env trimer apex); (iii) the CD4 binding site (CD4bs); (iv) the gp120/gp41 interface; or (v) the silent face of gp120. In some embodiments, the first multi-specific antigen binding molecule binds to the third variable loop (V3) (e.g., high mannose patch) comprising a N332 oligomannose glycan and the second or additional antigen binding molecules bind to the CD4 binding site (CD4bs). In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second or additional antigen binding molecules compete with or comprise VH and VL regions from GS-9723, GS-5423, 3BNC117, VRC07 and VRC07-523. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second or additional antigen binding molecules comprise an EC domain of CD4. In some embodiments, the first multi-specific antigen binding molecule binds to the CD4 binding site (CD4bs) and the second or additional antigen binding molecules bind to the third variable loop (V3) (e.g., high mannose patch) comprising a N332 oligomannose glycan. In some embodiments, the first multi-specific antigen binding molecule competes with or comprises VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of GS-9723, GS-5423, 3BNC117, VRC07 and VRC07-523, and the second or additional antigen binding molecules compete with or comprise VH and VL regions from 10-1074, 10-1074-J, GS-9722 (elipovimab), GS-2872, PGT-121, PGT-121.66, PGT-121.414 and PGT-134. In some embodiments, the first multi-specific antigen binding molecule competes with or comprises an EC domain of CD4, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises an EC domain of CD4, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the method further comprises administering second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the method further comprises administering second or additional antigen binding molecules compete with or comprise VH and VL regions from an antibody selected from the group consisting of GS-9723, GS-5423, 3BNC117, VRC07 and VRC07-523. In some embodiments, the methods comprise co-administering: (i) a multi-specific antigen binding molecule comprising a EC domain of CD4, described herein; (ii) an antibody or multi-specific antigen binding molecule that competes with or comprises VH and VL regions from an antibody selected from the group consisting of 10-1074, 10 1074-J, GS-9722 (elipovimab), GS-2872, PGT-121, PGT-121.66, PGT-121.414 and PGT-134; and (iii) an antibody or multi-specific antigen binding molecule that competes with or comprises VH and VL regions from an antibody selected from the group consisting of GS-9723, GS 5423, 3BNC117, VRC07 and VRC07-523. In some embodiments, the methods further comprise administering to the human subject an additional antigen binding molecule or antigen binding fragment thereof that at least one of binds, inhibits, and neutralizes HIV or a polynucleotide encoding the additional antigen binding molecule or antigen binding fragment thereof. In some embodiments, the method comprises administering an antibody or multi-specific antigen binding molecule that competes with or comprises VH and VL regions that bind to the gp120 third variable loop (V3) (e.g., high mannose patch) comprising a N332 oligomannose glycan, and the human subject is infected with an HIV expressing a gp120 comprising the following amino acid residues, wherein the positions and residues are with reference to SEQ ID NO:69: N332glycan, D325 and T63; N332glycan, D325 and L179; N332glycan, D325 and T320; N332glycan, D325 and H330; N332glycan, D325, T63 and L179; N332glycan, D325, T63 and T320; N332glycan, D325, T63 and H330; N332glycan, D325, L179 and T320; N332glycan, D325, L179 and H330; N332glycan, D325, T320 and H330; N332glycan, D325, T63, T320 and H330; N332glycan, D325, T63, L179 and T320; N332glycan, D325, T63, L179 and H330; N332glycan, D325, L179, T320 and H330; or N332glycan, D325, T63, L179, T320 and H330. In some embodiments, the method comprises administering an antibody or multi-specific antigen binding molecule that competes with or comprises VH and VL regions that bind to the gp120 CD4 binding site, and wherein the human subject is infected with an HIV expressing a gp120 comprising the following amino acid residues, wherein the positions and residues are with reference to SEQ ID NO:73: I201 and F353; I201, I108 and F353; I201, I108, A281 and F353; I201, E102, I108, A281 and F353; or I201, E102, I108, A281, Y318 and F353. In some embodiments, the method entails multiple administrations of the one or more multi-specific antigen binding molecules, optionally with a TLR agonist or an IL-15 receptor agonist, at predetermined intervals. In some embodiments, the method comprises administering a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist, wherein the multi-specific antigen binding molecule and the IL-15 receptor agonist are administered independently at predetermined intervals. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the subject is chronically infected with HIV. In some embodiments, the one or more multi-specific antigen binding molecules, the polynucleotide, the vector, the LNP and/or the pharmaceutical composition are administered systemically or locally. In some embodiments, the one or more multi-specific antigen binding molecules, the polynucleotide, the vector, the LNP and/or the pharmaceutical composition is administered via a route selected from intravenous, subcutaneous, intramuscular, intradermal and mucosal (e.g. buccal, intranasal, intrarectal, intravaginal). In some embodiments, the one or more multi-specific antigen binding molecules, the polynucleotide, the vector, the LNP and/or the pharmaceutical composition and the one or more additional therapeutic agents are administered by the same routes of administration. In some embodiments, the one or more multi-specific antigen binding molecules, the polynucleotide, the vector, the LNP and/or the pharmaceutical composition and the one or more additional therapeutic agents are administered by different routes of administration. In some embodiments, the one or more multi-specific antigen binding molecules, the polynucleotide, the vector, the LNP and/or the pharmaceutical composition and the one or more additional therapeutic agents are co-administered according to the same schedule (e.g., co-administered at the same time intervals). In some embodiments, the one or more multi-specific antigen binding molecules, the polynucleotide, the vector, the LNP and/or the pharmaceutical composition and the one or more additional therapeutic agents are co-administered according to different schedules (e.g., co-administered at different time intervals). In some embodiments, the one or more multi-specific antigen binding molecules, the polynucleotide, the vector, the LNP and/or the pharmaceutical composition is administered at a dose in the range of from 1 µg/kg to 5 µg/kg, e.g., from 350 µg/kg to 550 µg/kg, e.g., from 0.3 mg/kg to 30 mg/kg, e.g., from 2 mg/kg to 10 mg/kg, e.g., from 1 µg/kg up to 2 µg/kg, 3 µg/kg, 4 µg/kg, 5 µg/kg, 10 µg/kg, 50 µg/kg, 100 µg/kg, 250 µg/kg, 300 µg/kg, 350 µg/kg, 400 µg/kg, 410 µg/kg, 420 µg/kg, 430 µg/kg, 440 µg/kg, 450 µg/kg, 460 µg/kg, 470 µg/kg, 480 µg/kg, 490 µg/kg, 500 µg/kg, 750 µg/kg, 1 mg/kg, 1.5 mg/kg, 2 mg/kg, 2.5 mg/kg, 3 mg/kg, 3.5 mg/kg, 4 mg/kg, 4.5 mg/kg, 5 mg/kg, 6 mg/kg, 7 mg/kg, 8 mg/kg, 9 mg/kg, 10 mg/kg, 15 mg/kg, 20 mg/kg, 25 mg/kg, 30 mg/kg, 35 mg/kg, 40 mg/kg, 45 mg/kg, or 50 mg/kg, body weight per administration. In some embodiments, the one or more multi-specific antigen binding molecules, the polynucleotide, the vector, the LNP and/or the pharmaceutical composition is administered at a dose in the range of 0.05 mg to 1000 mg per administration, e.g., from 0.05 mg to 150 mg per administration, e.g., from 0.05 mg to 0.35 mg per administration, e.g., from 25 mg to 50 mg per administration, e.g., from 30 mg to 35 mg per administration, e.g., from 10 mg to 1000 mg per administration, e.g., from 50 mg to 1000 mg per administration, e.g., from 100 mg to 700 mg per administration, e.g., at least 0.05 mg up to 0.1 mg, 0.2 mg, 0.3 mg, 0.35 mg, 0.4 mg, 0.5 mg, 0.6 mg, 0.7 mg, 0.8 mg, 1.0 mg, 5 mg, 10 mg, 25 mg, 30 mg, 35 mg, 40 mg, 45 mg, 50 mg, 60 mg, 70 mg, 80 mg, 90 mg, 100 mg, 200 mg, 300 mg, 400 mg, 500 mg, 600 mg, 700 mg, 800 mg, 900 mg, or 1000 mg per administration. In some embodiments, the method entails multiple administrations of the one or more multi-specific antigen binding molecules, the polynucleotide, the vector, the LNP and/or the pharmaceutical composition, optionally with one or more additional therapeutic agents, at predetermined intervals. In some embodiments, the method entails administering over a time period of at least about 2 weeks, 3 weeks, 1 month, 6, weeks, 2 months, 10 weeks, 3 months, 4 months, 5 months, 6 months, 7 months, 8 months, 9 months, 10 months, 11 months, 12 months, 13 months, 14 months, 15 months, 16 months, 17 months, 18 months, 19 months, 20 months, 21 months, 22 months, 23 months, 24 months, or longer. In some embodiments, the method entails administering one or more times at predetermined intervals spaced at least 1 week and up to at least 2 weeks, 3 weeks, 1 month, 2 months, 3 months, 4 months, 5 months or 6 months apart. In some embodiments, the one or more multi-specific antigen binding molecules, the polynucleotide, the vector, the LNP and/or the pharmaceutical composition is administered once weekly (i.e., QW), once bi-weekly (i.e. once every other week, or once every two weeks or Q2W), once thrice-weekly (i.e. once every three weeks or Q3W), once monthly (i.e., QM) or once bi-monthly dosing (i.e. once every other month, or once every two months or Q2M), once every three months (Q3M), once every four months (Q4M), once every five months (Q5M), once every six months (Q6M), or less often. In some embodiments, the one or more multi-specific antigen binding molecules, the polynucleotide, the vector, the LNP and/or the pharmaceutical composition is administered two, three, four, five, or more, times intravenously or subcutaneously at an interval or at intervals between once bi-weekly (i.e. once every other week, or once every two weeks or Q2W) to once thrice-weekly (i.e. once every three weeks or Q3W). In some embodiments, the method entails the one or more multi-specific antigen binding molecules have a serum half-life in a human of at least 3 days, e.g., at least 4 days, at least 5 days, at least 6 days, at least 7 days, at least 8 days, at least 9 days, at least 10 days, at least 11 days, at least 12 days, at least 13 days, at least 14 days, at least 15 days, at least 16 days, or longer. In some embodiments, the subject or the mammal is a human. In some embodiments, the subject does not exhibit symptoms of HIV or AIDS in the absence of anti-retroviral treatment (ART) for at least 6 months, at least 1 year, at least 2 years, at least 3 years, or more. In some embodiments, the subject has a viral load of copies/ml blood of less than 500, e.g., less than 400, less than 300, less than 200, less than 100, less than 50, in the absence of anti-retroviral treatment (ART) for at least 6 months, at least 1 year, at least 2 years, at least 3 years, or more.

In a related aspect, provided are methods of treating or preventing HIV in a human subject in need thereof. In some embodiments, the methods comprise: (a) Identifying a human subject who is infected with an HIV expressing a gp120 comprising the following amino acid residues, wherein the positions and residues are with reference to SEQ ID NO:69: N332glycan, D325 and T63; N332glycan, D325 and L179; N332glycan, D325 and T320; N332glycan, D325 and H330; N332glycan, D325, T63 and L179; N332glycan, D325, T63 and T320; N332glycan, D325, T63 and H330; N332glycan, D325, L179 and T320; N332glycan, D325, L179 and H330; N332glycan, D325, T320 and H330; N332glycan, D325, T63, T320 and H330; N332glycan, D325, T63, L179 and T320; N332glycan, D325, T63, L179 and H330; N332glycan, D325, L179, T320 and H330; or N332glycan, D325, T63, L179, T320 and H330; and (b) Administering to the subject an effective amount of the multi-specific antigen binding molecule, described herein, or the pharmaceutical composition, described herein, wherein the second binding domain competes with or comprises VH and VL regions that bind to the third variable loop (V3) (e.g., high mannose patch) comprising a N332 oligomannose glycan. In some embodiments, the methods comprise identifying a subject infected with an HIV or a population of HIV expressing a gp120 comprising the following amino acid residues: N332glycan, D325 and T63; N332glycan, D325 and L179; N332glycan, D325 and T320; or N332glycan, D325 and H330. In some embodiments, the methods comprise identifying a subject infected with an HIV or a population of HIV expressing a gp120 comprising the following amino acid residues: N332glycan, D325, T63 and L179; N332glycan, D325, T63 and T320; N332glycan, D325, T63 and H330; N332glycan, D325, L179 and T320; N332glycan, D325, L179 and H330; or N332glycan, D325, T320 and H330. In some embodiments, the methods comprise identifying a subject infected with an HIV or a population of HIV expressing a gp120 comprising the following amino acid residues: N332glycan, D325, L179, T320 and H330; N332glycan, D325, T63, T320 and H330; N332glycan, D325, T63, L179 and T320; or N332glycan, D325, T63, L179 and H330. In some embodiments, the methods comprise identifying a subject infected with an HIV or a population of HIV expressing a gp120 comprising the following amino acid residues: N332glycan, D325, T63 and H330; N332glycan, D325, T320 and H330; N332glycan, D325, L179, T320 and H330; or N332glycan, D325, T63, L179, T320 and H330. In some embodiments, the second antigen binding domain competes with or comprises VH and VL regions from an antibody selected from the group consisting of 10-1074, 10-1074-J, GS-9722 (elipovimab), GS-9721, GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second antigen binding domain competes with or comprises VH and VL regions from an antibody selected from the group consisting of 10-1074, 10-1074-J, GS-9722 (elipovimab), GS-9721, GS-2872, PGT-121, PGT-121.66, PGT-121.414 and PGT-134. In some embodiments, the method entails treating or preventing HIV in a human subject in need thereof, the method comprising: (a) Identifying a human subject who is infected with an HIV expressing a gp120 comprising the following amino acid residues, wherein the positions and residues are with reference to SEQ ID NO:73: (i) I201 and F353; (ii) I201, I108 and F353; (iii) I201, A281 and F353; (iv) I201, E102, I108, A281 and F353; or (v) I201, E102, I108, A281, Y318 and F353; and (b) Administering to the subject an effective amount of the multi-specific antigen binding molecule, or the pharmaceutical composition as described herein, wherein the second binding domain competes with or comprises VH and VL regions that bind to the gp120 CD4 binding site (CD4bs). In some embodiments, the second antigen binding domain competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the second antigen binding domain competes with or comprises VH and VL regions from an antibody selected from the group consisting of 3BNC117, GS-9723, GS-5423, 3BNC60, VRC01, VRC07 and VRC07-523. In some embodiments, the methods further comprise administering to the subject a second agent for treating an HIV infection. In some embodiments, the subject is not receiving antiretroviral therapy (ART) or ART is discontinued prior to administration of the one or more multi-specific antigen binding molecules. In some embodiments, ART is discontinued after one or more administrations of the one or more multi-specific antigen binding molecules. In some embodiments, the methods further comprise administering one or more antiretroviral therapy (ART) agents to the subject. In some embodiments, the methods further comprise administering to the subject at least one of a TLR agonist and an IL-15 receptor agonist. In some embodiments, the method comprises administering a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the TLR agonist is a TLR2 agonist, a TLR3 agonist, a TLR7 agonist, a TLR8 agonist or a TLR9 agonist. In some embodiments, the TLR7 agonist is selected from the group consisting of vesatolimod, imiquimod, and resiquimod. In some embodiments, the methods entail multiple administrations of the one or more multispecific antigen binding molecules, optionally with the TLR agonist, at predetermined intervals. In some embodiments, the subject does not exhibit symptoms of HIV or AIDS in the absence of anti-retroviral treatment (ART) for at least 6 months, at least 1 year, at least 2 years, at least 3 years, or more. In some embodiments, the subject has a viral load copies/ml blood of less than 500, e.g., less than 400, less than 300, less than 200, less than 100, less than 50, in the absence of anti-retroviral treatment (ART) for at least 6 months, at least 1 year, at least 2 years, at least 3 years, or more.

In a further aspect, provided is the use of the multispecific (e.g., bispecific) antigen binding molecules or antigen binding fragment thereof, or the pharmaceutical compositions, as described herein, in a method of at least one of treating, preventing and inhibiting HIV in a human subject in need thereof. In a further aspect, provided are the multispecific (e.g., bispecific) antigen binding molecules or antigen binding fragment thereof, or the pharmaceutical compositions, as described herein, for use in a method of at least one of treating, preventing and inhibiting HIV in a human subject in need thereof. In some embodiments, the use further comprises administering to the subject a second agent for treating an HIV infection. In some embodiments, the use further comprises administering to the subject at least one of a TLR agonist and an IL-15 receptor agonist. In some embodiments, the use entails administering a multispecific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO: 746). In some embodiments, the TLR agonist is a TLR2 agonist, a TLR3 agonist, a TLR7 agonist, a TLR8 agonist or a TLR9 agonist. In some embodiments, the TLR7 agonist is selected from the group consisting of vesatolimod, imiquimod, and resiquimod. In some embodiments, the use comprises administering a first multi-specific antigen binding molecule and second or additional antigen binding molecules, wherein the first multi-specific antigen binding molecule and the second or additional antigen binding molecules bind to different first and second epitopes or regions of gp120 selected from the group consisting of: (i) third variable loop (V3) (e.g., high mannose patch) comprising a N332 oligomannose glycan; (ii) second variable loop (V2) (e.g., Env trimer apex); (iii) CD4 binding site (CD4bs); (iv) gp120/gp41 interface; or (v) silent face of gp120. In some embodiments, the first multi-specific antigen binding molecule binds to the third variable loop (V3) (e.g., high mannose patch) comprising a N332 oligomannose glycan, and the second antigen binding molecule binds to the CD4 binding site (CD4bs). In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second antigen binding molecule competes with or comprises VH and VL regions from an antibody selected from the group consisting of b12, F105, VRC01, VRC07, VRC07-523, VRC03, VRC06, VRC06b01 VRC08, VRC0801, NIH45-46, 3BNC117, 3BNC60, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second antigen binding molecule competes with or comprises VH and VL regions from 3BNC117, GS-9723, VRC07 or VRC07-523. In some embodiments, the first multi-specific antigen binding molecule competes with or comprises VH and VL regions from an antibody selected from the group consisting of 10-1074, 10-1074-J, GS-9722 (elipovimab), GS-2872, PGT-121, PGT-121.66, PGT-121.414 and PGT-134, and the second antigen binding molecule comprises an EC domain of CD4. In some embodiments, the first multi-specific antigen binding molecule binds to the CD4 binding site (CD4bs) and the second or additional antigen binding molecules bind to the third variable loop (V3) (e.g., high mannose patch) comprising a N332 oligomannose glycan. In some embodiments, the first multi-specific antigen binding molecule competes with or comprises VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of GS-9723, GS-5423, 3BNC117, VRC07 and VRC07-523, and the second or additional antigen binding molecules compete with or comprise VH and VL regions from 10-1074, 10-1074-J, GS-9722 (elipovimab), GS-2872, PGT-121, PGT-121.66, PGT-121.414 and PGT-134. In some embodiments, the first multi-specific antigen binding molecule competes with or comprises an EC domain of CD4, and the second or additional antigen binding molecules compete with or comprise VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises an EC domain of CD4, and the second or additional antigen binding molecules compete with or comprise VH and VL regions from an antibody selected from the group consisting of 10-1074, 10-1074-J, GS-9722 (elipovimab), GS-2872, PGT-121, PGT-121.66, PGT-121.414 and PGT-134. In some embodiments, the use further comprises administering second or additional antigen binding molecules compete with or comprise VH and VL regions from an antibody selected from the group consisting of GS-9723, GS-5423, 3BNC117, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the use further comprises administering second or additional antigen binding molecules compete with or comprise VH and VL regions from an antibody selected from the group consisting of GS-9723, GS-5423, 3BNC117, VRC07 and VRC07-523. In some embodiments, the use comprises co-administering: (i) a multi-specific antigen binding molecule comprising an EC domain of CD4, as described herein; (ii) an antibody that competes with or comprises VH and VL regions from an antibody selected from the group consisting of 10-1074, 10 1074-J, GS-9722 (elipovimab), GS-2872, PGT-121, PGT-121.66, PGT-121.414 and PGT-134; and (iii) an antibody that competes with or comprises VH and VL regions from an antibody selected from the group consisting of GS-9723, GS 5423, 3BNC117, VRC07 and VRC07-523. In some embodiments, the use further comprises administering to the human subject an additional antigen binding molecule or antigen binding fragment thereof that at least one of binds, inhibits, and neutralizes HIV or a polynucleotide encoding the additional antigen binding molecule or antigen binding fragment thereof. In some embodiments, the human subject is infected with an HIV expressing a gp120 comprising the following amino acid residues: N332/D325; N332/D325/H330; N332/D325/H330/T320; N332/D325/H330/T63; N332/D325/H330/T63/T320; or N332/D325/H330/T63/T320/L179.

Unless otherwise defined, all technical and scientific terms used herein have the same meaning as commonly understood by one of ordinary skill in the art to which this invention belongs. Although methods and materials similar or equivalent to those described herein can be used in the practice or testing of the present bispecific molecules described herein, the exemplary methods and materials are described below. All publications, patent applications, patents, and other references mentioned herein are incorporated by reference in their entirety. In case of conflict, the present application, including definitions, will control. The materials, methods, and examples are illustrative only and not intended to be limiting.

Other features and advantages of the invention will be apparent from the following detailed description and from the claims.

BRIEF DESCRIPTION OF THE DRAWINGS

FIG. 1 illustrates a homology model of mSP34. The sidechains of potential solvent exposed sequence liabilities are shown as spheres and labelled using single letter amino acid nomenclature and numbered according to Kabat.

FIGS. 2A-2B. FIG. 2A illustrates a sequence alignment of the mSP34 heavy chain variable domain and five comparators found in clinical stage antibodies. Potential solvent exposed sequence liabilities (FIG. 1) are underlined. FIG. 2A depicts SEQ ID NOs: 1044-1049, respectively, in order of appearance. FIG. 2B illustrates a sequence alignment of the mSP34 light chain variable domain and five comparators found in clinical stage antibodies. FIG. 2B depicts SEQ ID NOs: 1050-1055, respectively, in order of appearance.

FIGS. 4A-4B. FIG. 4A illustrates a heavy chain (HC) sequence alignment of mSP34, the closest human germline and the first round of huSP34 heavy chain variants (SEQ ID NOs: 1064-1075, respectively, in order of appearance). FIG. 4B illustrates a light chain (LC) sequence alignment of mSP34, the closest human germline and the first round of huSP34 light chain variants (SEQ ID NOs: 1056-1063, respectively, in order of appearance).

FIGS. 5A-5B. FIG. 5A illustrates a heavy chain (HC) sequence alignment of mSP34, the closest human germline and the second round of huSP34 heavy chain variants ((SEQ ID NOs: 1082-1087, respectively, in order of appearance). FIG. 5B illustrates a light chain (LC) sequence alignment of mSP34, the closest human germline and the second round of huSP34 light chain variants (SEQ ID NOs: 1076-1081, respectively, in order of appearance).

FIGS. 7A-7D. FIG. 7A illustrates examples of scFv-Fc/Fab-Fc bispecific antibodies designed as part of the present bispecific molecules. FIG. 7B illustrates examples of CD4 ECD-Fc/Fab-Fc bispecific fusion proteins designed as part of the present bispecific molecules. FIG. 7C illustrates examples of CD4 ECD-Fc/scFv-Fc bispecific fusion proteins designed as part of the present bispecific molecules. FIG. 7D illustrates examples of CD4 ECD-Fc/scFv-Fc or CD4 ECD-Fc/Fab-Fc bispecific fusion proteins incorporating bivalent or tandem CD4 ECDs and designed as part of the present bispecific molecules. All technologies illustrated are optional and may be omitted or used in combinations beyond what is shown in these figures. Key: ΔEF=remove effector function (e.g., FcγR binding reduced or eliminated with at least one of L234A and L235A (LALA) mutations; C1q binding reduced or eliminated with P331S mutation; collectively "AAS"); knob and hole=engineered Fc heterodimer (e.g., "hole" (H) mutations include T366S, L368A and Y407V ("SAV"); "knob" (K) mutations include T366W ("W"); HLE=half-life extension (e.g., M252Y, S254T and T256E ("YTE") or M428L and N434S ("LS")); ΔProA=reduce or eliminate Protein A binding (e.g., H435R or H435R+Y436F ("RF")); linker=scFv linker (e.g., $(GGGS)_4$ (SEQ ID NO: 711) or $(GGGGS)_4$ (SEQ ID NO: 750)).

FIG. 8A illustrates representative HiTrap® SP HP (Cytiva Life Sciences) cation exchange chromatography (employed to isolate the bispecific antibody or fusion protein Fc heterodimer from Fc homodimer or other contaminants with low isoelectric points (pI) using a gradient of 0-30% 1M NaCl in 20 mM sodium phosphate pH 7.0) to separate the desired bispecific antibody or fusion protein Fc heterodimer from Fc homodimer or other contaminants with low isoelectric points (pI)) and SDS-PAGE analysis for purification of the hPGT121.66 (see, e.g., WO 2018/237148) AAS+W/huSP34.13.10scFv AAS+SAV+RF Fab-scFv-Fc bispecific antibody (Ab 265; SEQ ID NOs: 848, 829 and 823) (bispecific molecules described herein are summarized in Table 53). FIG. 8B illustrates representative HiTrap® SP HP (Cytiva Life Sciences) cation exchange chromatography results and SDS-PAGE analysis for purification of the hCD4 D1.22 Fc AAS+SAV+YTE/huSP34.3.13 AAS+W+YTE Fab-Fc-fusion bispecific molecule 185.

Figure 30:
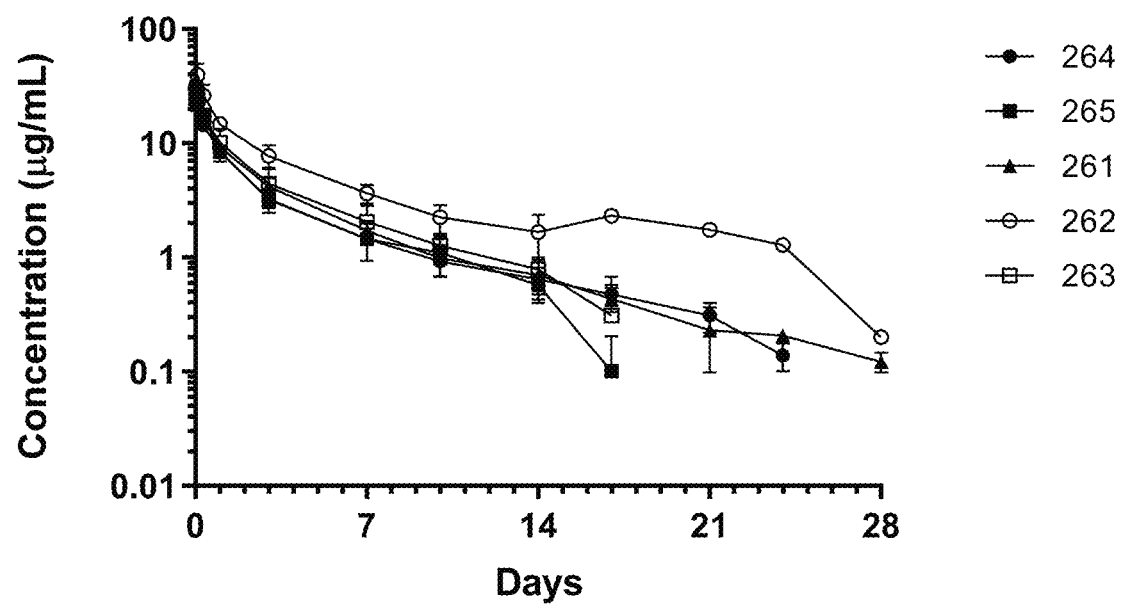

FIG. 30 illustrates PK profiles for PGT121.66×huSP34 bispecific molecules 264 (solid circle), 265 (solid square), 261 (solid triangle), 262 (open circle), and 263 (open square) following 1 mg/kg IV dosing to naïve male cynomolgus monkeys (n=3). Each symbol is the measured mean±SD serum concentration.

Figure 31:
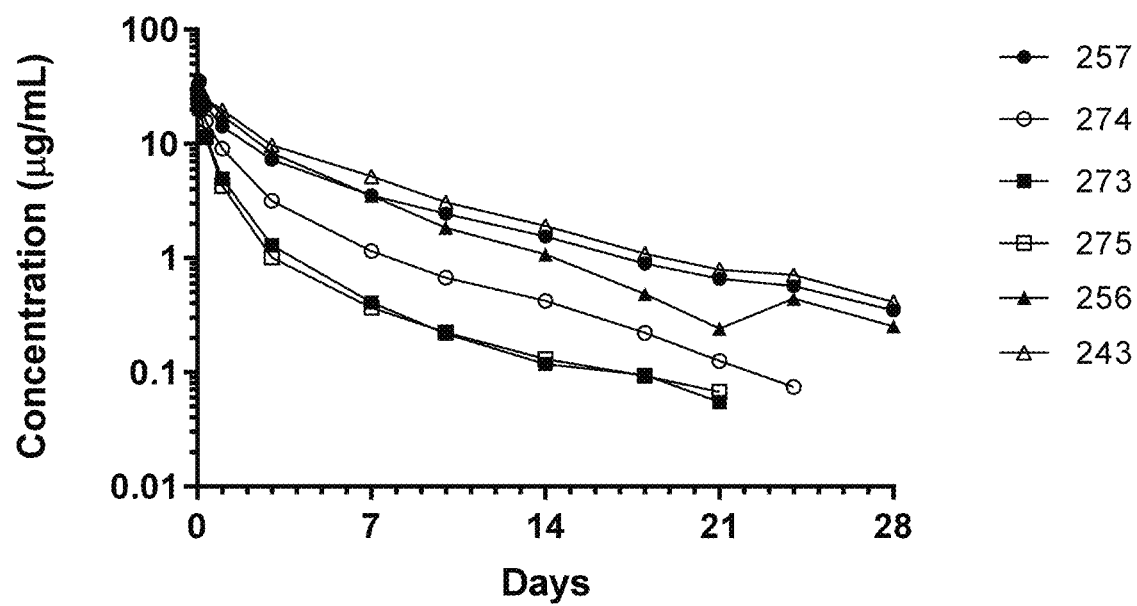

FIG. 31 illustrates PK profiles for PGT121.66×huSP34 bispecific molecules 257 (solid circle), 274 (open circle), 273 (solid square), 275 (open square), 256 (solid triangle), and 243 (open triangle) following 1 mg/kg IV dosing to naïve male cynomolgus monkeys (n=2). Each symbol is the measured mean serum concentration.

Figure 32:
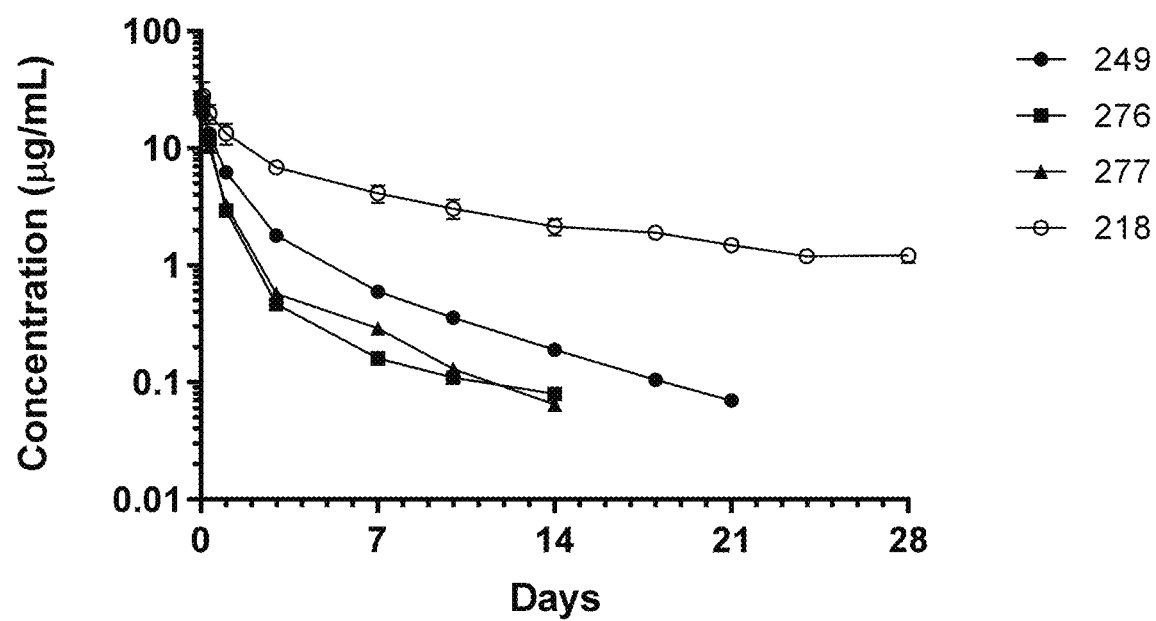

FIG. 32 illustrates PK profiles for PGT121.66×huSP34 bispecific molecules 249 (solid circle), 276 (solid square), 277 (solid triangle), and 218 (open circle) following 1 mg/kg IV dosing to naïve male cynomolgus monkeys (n=2 or 3). Each symbol is the measured mean±SD serum concentration.

Figure 33:
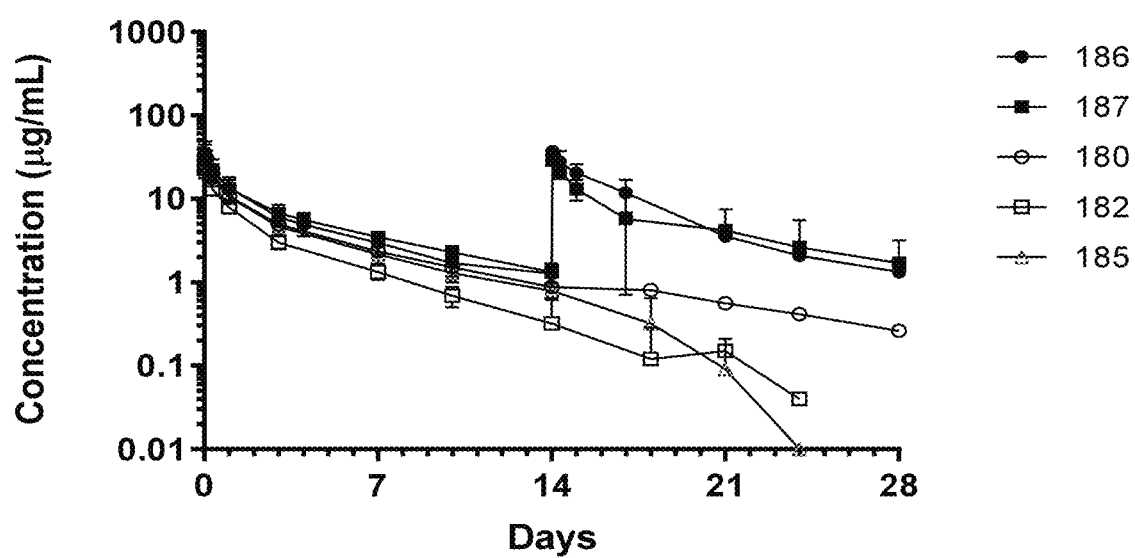

FIG. 33 illustrates PK profiles for CD4 ECD×huSP34 bispecific molecules 186 (solid circle), 187 (solid square), 180 (open circle), 182 (open square), and 185 (open triangle) following 1 mg/kg IV dosing to naïve male cynomolgus monkeys (n=3). Bispecific molecules 186 and 187 were dosed on Day 0 and 14. Each symbol is the measured mean±SD serum concentration.

Figure 34:
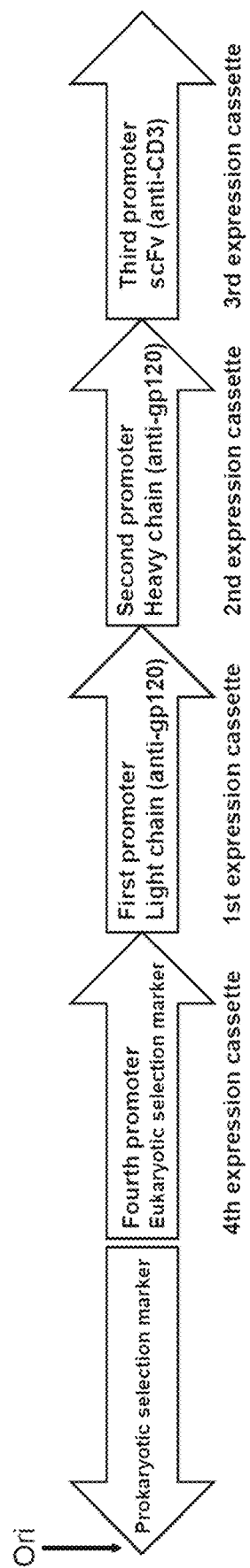

FIG. 34 illustrates organization of an expression vector having polynucleotide sequences encoding the expression of the three polypeptide chains of an asymmetric bispecific molecule having an anti-HIV gp120 Fab and an anti-CD3 scFv. The vector was designed to drive the expression of three polypeptide chains: heavy chain and light chain of anti-gp120 Fab and scFv of anti-CD3 from three separate expression cassettes, each driven by its own promoter of equal transcription strength (e.g., a cytomegalovirus (CMV) promotor). An additional DNA cassette having a polynucleotide encoding a eukaryotic selection marker (e.g., glutamine synthetase (GS)) using a promoter of relatively weaker transcription strength (e.g., an SV40 promoter) was included in the expression vector. DNA encoding for a bacterial origin of replication (e.g., Ori) and an antibiotic selection marker (e.g., ampicillin (AmpR)) were utilized for expression vector production in E. coli.

Figure 35:
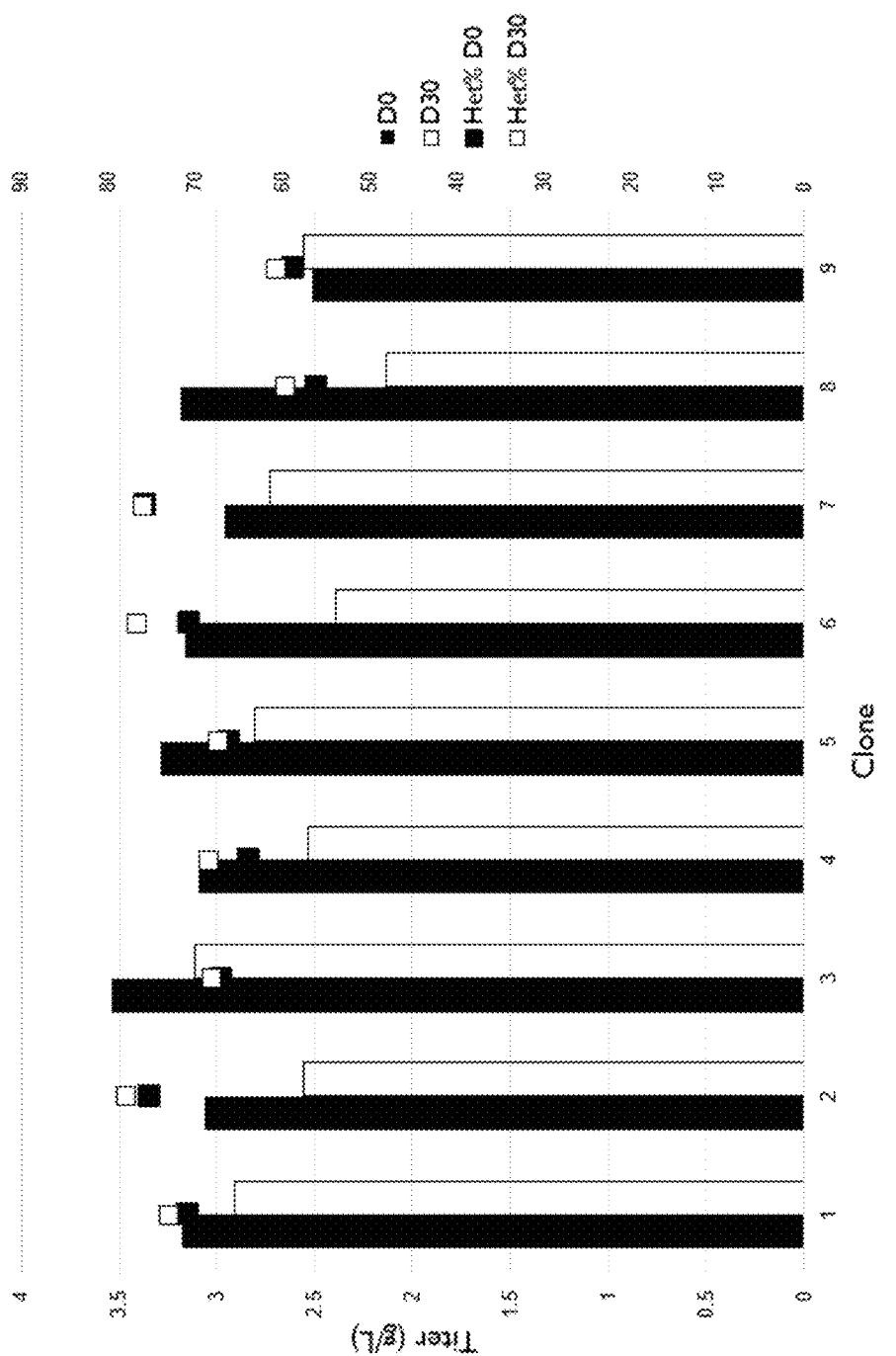

FIG. 35 illustrates an evaluation of expression performance of cell lines expressing asymmetric bispecific molecules having an anti-HIV gp120 Fab and an anti-CD3 scFv. The expression performance was assessed by culturing the cells expressing the bispecific molecules in a fed-batch process and evaluating their performance at baseline (D0) and upon aging (D30). Expression of multiple species including the bispecific molecule of interest was measured using a ProA based Bio-layer interferometry and the relative levels of the heterotrimer (Het %, heterotrimer %) comprising the asymmetric bispecific molecule was monitored using size separation methods (non-reduced capillary electrophoresis).

Figure 36:
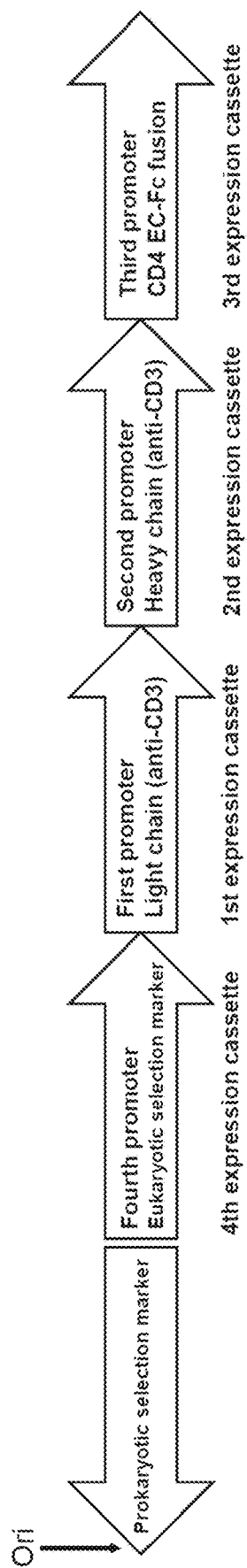

FIG. 36 illustrates organization of an expression vector having polynucleotide sequences encoding the expression of the three polypeptide chains of an asymmetric bispecific molecule having an anti-CD3 Fab and a CD4 extracellular (EC) domain-Fc fusion protein. The vector was designed to drive the expression of three polypeptide chains: heavy chain and light chain of anti-CD3 Fab and CD4-Fc fusion protein from three separate expression cassettes, each driven by its own promoter of equal transcription strength (e.g., a cytomegalovirus (CMV) promotor). An additional DNA cassette having a polynucleotide encoding a eukaryotic selection marker (e.g., glutamine synthetase (GS)) using a promoter of relatively weaker transcription strength (e.g., an SV40 promoter) was included in the expression vector. DNA encoding for a bacterial origin of replication (e.g., Ori) and an antibiotic selection marker (e.g., ampicillin (AmpR)) were utilized for expression vector production in E. coli.

Figure 37:
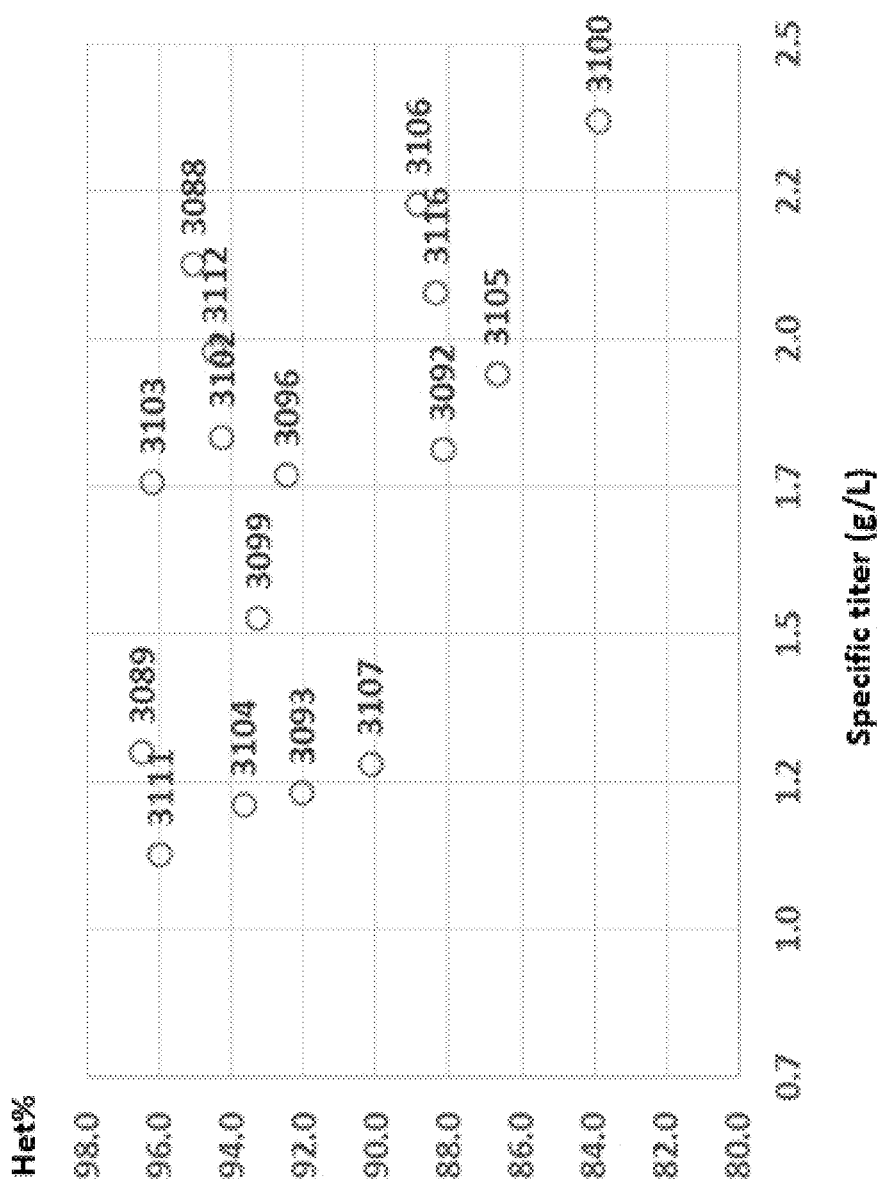

FIG. 37 illustrates an evaluation of expression performance of cell lines expressing asymmetric bispecific molecules having an anti-CD3 Fab and a CD4-Fc fusion protein. The expression performance was assessed by culturing the cells under the production mode (fed-batch process). Each dot represents the selected clones, where the ratio of the desired species (Het %, heterotrimer %) was monitored by size separation method (non-reduced capillary electrophoresis). The amounts of desired heterotrimer comprising the asymmetric bispecific molecule were calculated as the amount of total bispecific molecule (detected via ProA Biosensors) and then multiplied by the heterotrimer % (specific titer in g/L).

Figure 38:
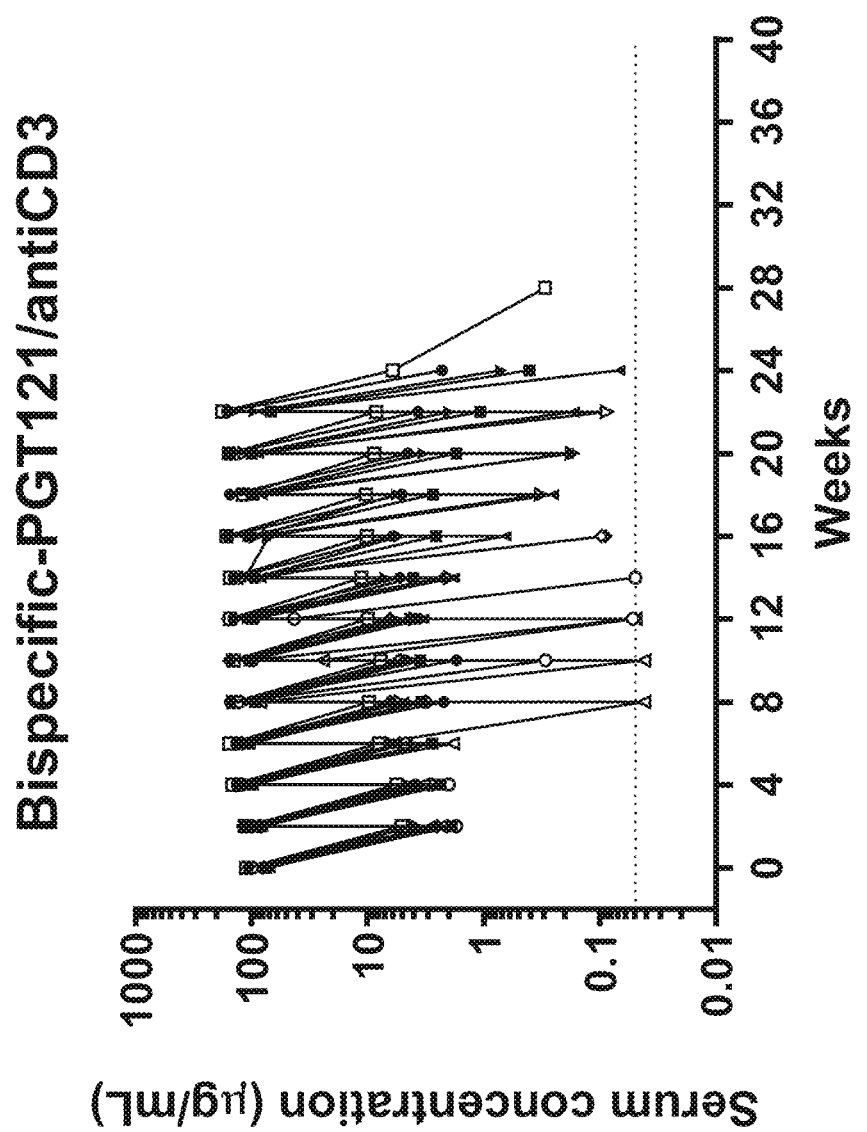

FIG. 38 illustrates PGT121/anti-CD3 bispecific antibody pharmacokinetics in serum before ART discontinuation. Peak serum antibody levels are shown following each of the twelve infusions (2 infusions first with anti-CD3KO version followed by 10 of anti-CD3 version) of antibody and during the washout period. Dotted lines indicate limit of detection. Dotted line indicates limit of detection.

Figure 39:
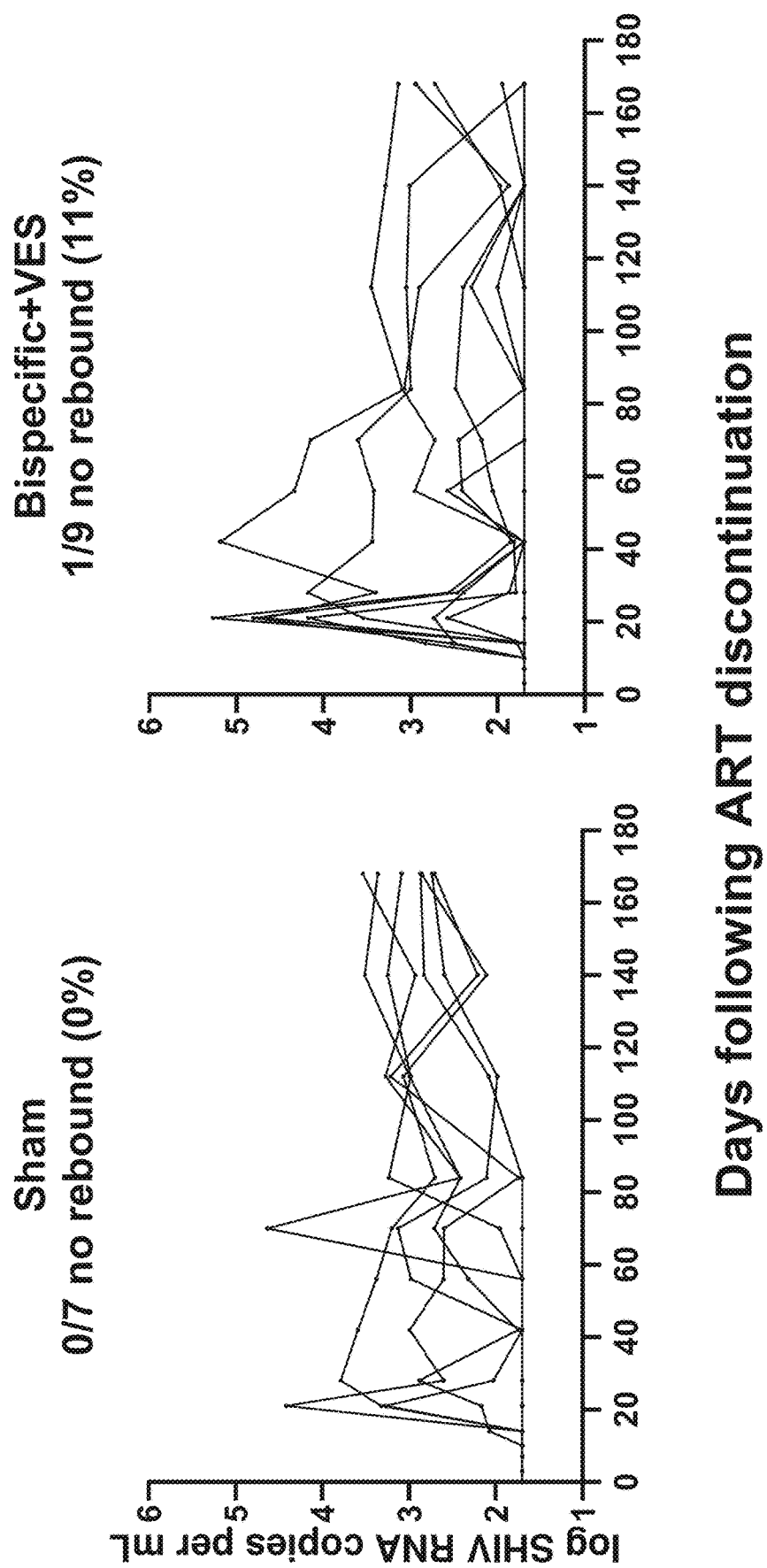

FIG. 39 illustrates SHIV viral loads following ART discontinuation. Plasma viral load for 168 days following ART discontinuation. Numbers and percentages of animals that did not show viral rebound are shown. Limit of detection is 1.7 log RNA copies per ml.

Figure 40:
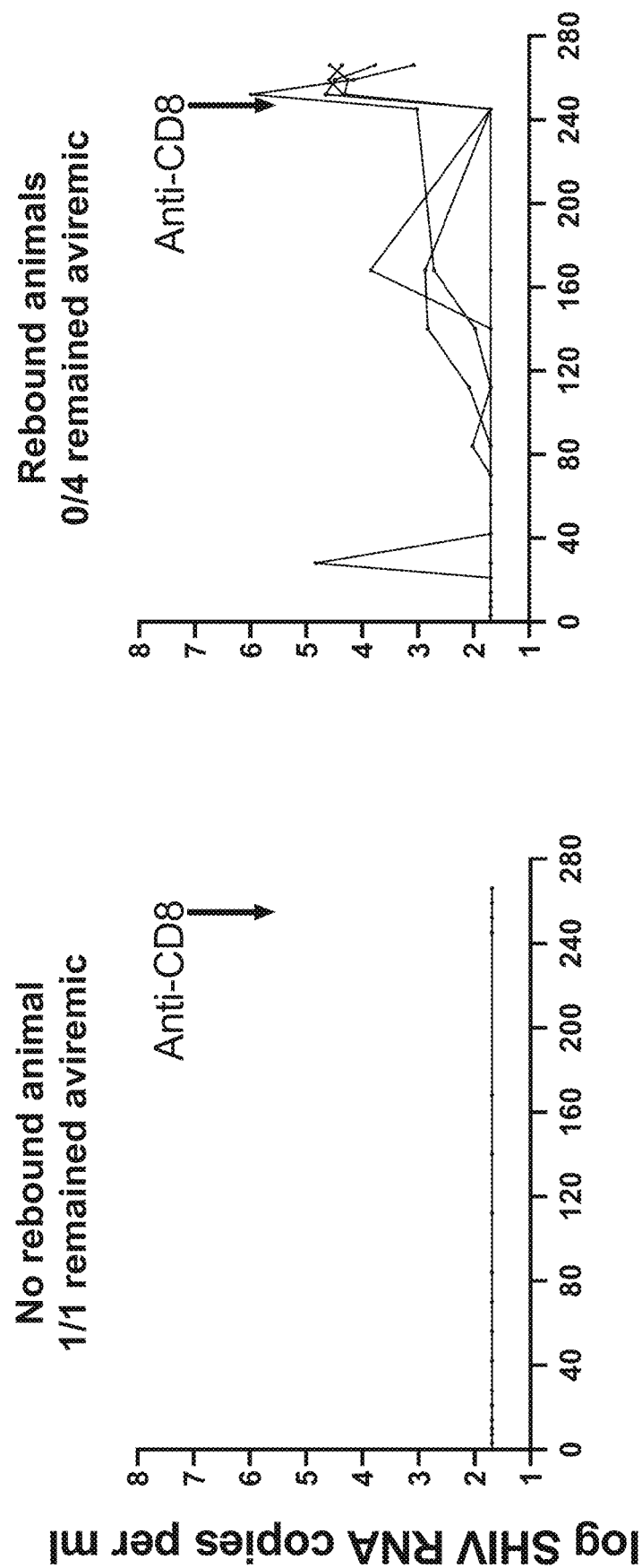

FIG. 40 illustrates plasma viral loads before and after CD8+ cell depletion in animals with no viral rebound (n=1) and animals with viral rebound (n=4) following ART discontinuation. Numbers of animals that remained aviremic and total number of animals are shown. Arrows indicate CD8+ cell depletion on day 245 (week 77) after ART discontinuation. Limit of detection is 1.7 log RNA copies per ml.

DETAILED DESCRIPTION

1. Introduction

Provided are multi-specific or bispecific antigen binding molecules, targeting CD3 and an HIV antigen (e.g., gp120 or gp41), designed for improved manufacturing efficiency, reduced cost, improved drug-like properties (e.g., increased sequence identity to human germline and reduced off-target binding and inducement of anti-drug antibodies (ADAs)). The Fc-containing multi-specific or bispecific molecules described herein can be efficiently produced at high yield using a single cell line with a simplified purification process. We have developed multi-specific or bispecific molecules having an anti-CD3 antibody variable domain with (1) a high affinity for human and non-human primate (NHP) (e.g., to facilitate pre-clinical toxicity studies) CD3, (2) a high sequence similarity to the human germline (e.g., to reduce or eliminate risk of immunogenicity and anti-drug antibody (ADA) reactions in human patients), (3) IgG-like pharmacokinetic (PK) properties with no evidence of ADA in non-human primates (e.g., to facilitate pre-clinical efficacy and toxicity studies) (4) reduced product heterogeneity via removal of sequence liabilities (e.g., deamidation, aspartate isomerization) to improve manufacturing, (5) high thermodynamic stability (e.g., to ensure product stability), (6) low aggregate content (e.g., to reduce risk of immunogenicity), (7) low polyspecificity (to reduce the risk of immunogenicity and improve PK properties), and (8) a heavy chain variable region (VH) with low or no binding to Protein A affinity chromatography resin (e.g., to facilitate efficient purification of bispecific antibody heterodimers). Further the anti-CD3 antibody variable domain possesses all the foregoing desirable properties in both scFv and Fab formats, such that it can be incorporated into a variety of bispecific antibody formats containing three or fewer polypeptide chains, e.g., to limit light chain miss-pairing or other sources of bispecific antibody product heterogeneity.

In some embodiments, the multi-specific or bispecific molecules comprise a first antigen binding domain, targeting human CD3, that is a single chain variable fragment (scFv) fused to Fc, while the second antigen binding domain, targeting an HIV antigen (e.g., gp120 or gp41) is comprised of a Fab antigen binding fragment fused to Fc. The resulting molecules have three polypeptide chains (i.e., scFv heavy chain, Fab heavy chain, Fab light chain), which are co-expressed in a single cell line. Formation of the desired bispecific heterodimeric molecule is facilitated through use of mutations in the Fc region that limits unwanted homodimerization of either half molecule, while the use of a scFv fragment as one of the antigen binding arms eliminates the need to co-express two different light chains that can otherwise lead to heterogeneity resulting from incorrect light chain pairing. Purification of the multi-specific antigen binding molecules is simplified and improved by eliminating the ability of the variable regions and one the of Fc regions to bind Protein A. Employing this design strategy, one of the two possible homodimer impurities is not retained during Protein A-based capture of the bispecific from cell culture media.

In various embodiments of the present multi-specific antigen binding molecules the first and second Fc regions of native human IgG sequences can be modified to promote heavy chain heterodimerization, allow for simplified and efficient purification, and to reduce or remove binding to FcγR and C1q.

Heterodimerization of the first and second Fc regions can be facilitated by introduction of 'knobs-into-holes' mutations (Atwell et al. 1997. JMB 270:26-35). The 'hole' mutations (T366S, L368A and Y407V) are incorporated into one Fc-containing chain, the T366W 'knob' mutation is used in the other chain (Atwell et al., supra). In addition, the C220S mutation can be incorporated into the IgG1 hinge region of the scFv-containing arm to eliminate the free cysteine, which would otherwise form a disulfide bond with a corresponding cysteine in an immunoglobulin light chain. Co-transfection of such constructs into a single host cell promotes formation of a heterodimeric Fc, with low levels of homodimer contaminants. The S354C (made in the Fc containing the 'knob' mutations) and Y349C (made in the Fc containing the 'hole' mutations) mutations can optionally be incorporated to generate a covalent bond between the two halves of the heterodimeric Fc if additional thermodynamic stability is desired (Merchant et al. 1998. Nat. Biotechnol. 16: 677-81). As described herein, numbering of amino acid positions for substitutions in the first and second Fc regions is according to Eu index.

Purification of the heterodimeric molecule away from contaminating homodimeric products can be facilitated by introducing into the first or the second Fc region H435R or H435R+Y436F mutations to reduce or eliminate Protein A binding (Jendeberg, L. et al. 1997 J. Immunol. Methods 201:25-34), optionally combined with mutations in any variable heavy (VH) region of the same chain should such VH be derived from a human VH3 germline. For example, additional VH mutations can be made at one or more of positions R19, T57, G65, Q81 and N82a, as numbered according to the Kabat numbering system. Incorporation of such amino acid substitutions in the Fc region, and optionally in the VH region, can reduce or eliminate Protein A binding of the homodimer contaminants, and greatly simplifies purification of the desired heterodimer away from remaining homodimer contaminant via additional chromatography steps (e.g., ion exchange).

In certain embodiments, the first and second Fc domain or Fc region incorporate amino acid substitutions to reduce or eliminate one or more of effector function (antibody-dependent cellular cytotoxicity (ADCC), antibody-dependent cellular phagocytosis (ADCP), and complement-dependent cytotoxicity (CDC)). In these contexts, at least one of the first and second Fc region can incorporate one or both of the L234A and L235A mutations to reduce or eliminate FcγR binding (Chappel, M. S et al. 1991 PNAS 88:9036-9040), and/or the P331S mutation to reduce or eliminate C1q binding (Xu Y, et al. J Biol Chem. 1994. 269:3469-74).

scFv fragments represent a minimal antibody-derived antigen binding unit, and are generated by direct fusion of a variable heavy and variable light domain via a flexible polypeptide linker (Huston et al., 1988, PNAS 85:5879-5883). The sequence of this linker can contain 3 or 4 repeats of a GGGGS motif (SEQ ID NO: 712) (Desplancq et al. 1994, Protein Engineering 7:1027-1033). In various embodiments, the G44C mutation (variable heavy domain) and the G100C mutation (variable light domain) can be incorporated to generate a covalent disulfide bond between the VH and VL domains of the scFv if additional thermodynamic stability is desired (Brinkmann, U et al., 1993, PNAS 90: 7538-7542).

In embodiments comprising a first antigen binding domain in the form of a scFv, and a second antigen binding domain in the form of a Fab, the three polypeptide chains can co-expressed in a single host cell and purified via Protein A chromatography. The desired Fab-scFv-Fc heterodimer is the dominant species observed in non-reducing SDS-PAGE analysis. Contaminating homodimeric species can be further mitigated using the H435R or H435R+Y436F mutations in the first or second Fc regions. Subsequent polishing using ion exchange chromatography and dialysis into a standard formulation buffer generates final material with high purity and homogeneity, e.g., that is at least 90%, e.g., at least 91%, 92%, 93%, 94%, 95%, 96%, 97%, 98%, 99%, or more, pure.

2. Anti-CD3 Effector Arm

Cluster of Differentiation (CD3) is a multimeric protein complex that is composed of four distinct polypeptide chains: epsilon (ε) (CD3E; NCBI Gene ID: 916), gamma (γ) (CD3G; NCBI Gene ID: 917), delta (δ) (CD3D; NCBI Gene ID: 915) and zeta (ζ) (CD247; NCBI Gene ID: 919), that assemble and function as three pairs of dimers (εγ, ζζ). CD3 proteins have an N-terminal extracellular region, a transmembrane domain, and a cytoplasmic tail where the immunoreceptor tyrosine activation motifs (ITAMs) are located. The extracellular domains of CD3 ε, γ and δ contain an immunoglobulin-like domain and thus are considered part of the immunoglobulin superfamily. The CD3/T-cell co-receptor helps to activate both CD8$^+$ T-cells and also CD4$^+$ T-cells.

The amino acid sequence of human CD3ε can be found at UNiProtKB-P07766 and is provided below (the signal sequence is underlined):

(SEQ ID NO: 130)
MQSGTHWRVL GLCLLSVGVW GQDGNEEMGG ITQTPYKVSI

SGTTVILTCP QYPGSEILWQ HNDKNIGGDE DDKNIGSDED

HLSLKEFSEL EQSGYYVCYP RGSKPEDANF YLYLRARVCE

NCMEMDVMSV ATIVIVDICI TGGLLLLVYY WSKNRKAKAK

PVTRGAGAGG RQRGQNKERP PPVPNPDYEP IRKGQRDLYS

GLNQRRI

The amino acid sequence of human CD3δ can be found at UNiProtKB-P04234 and is provided below (the signal sequence is underlined):

(SEQ ID NO: 319)
MEHSTFLSGL VLATLLSQVS PFKIPIEELE DRVFVNCNTS

ITWVEGTVGT LLSDITRLDL GKRILDPRGI YRCNGTDIYK

DKESTVQVHY RMCQSCVELD PATVAGIIVT DVIATLLLAL

GVFCFAGHET GRLSGAADTQ ALLRNDQVYQ PLRDRDDAQY

SHLGGNWARN K

Antibodies that bind human CD3 have been described, e.g., in Kuhn & Weiner, Immunotherapy, 8(8):889-906 (2016); WO 2015/001085; WO 2015/104346. OKT3 (Muromonab-CD3), an anti-CD3 antibody directed against CD3ε, has been clinically approved for use in humans for the induction of immunosuppression in solid organ transplantation for the prevention and treatment of rejection (Norman, *Therapeutic Drug Monitoring*, 17, 615-620 (1995)). Teplizumab, also known under the names hOKT3γ1 (Ala-Ala) and MGA031, is a humanized IgG1 antibody that was developed by grafting the complementarity determining region of OKT3 into a human IgG1 backbone. Introduction of two point mutations in its Fc portion decreases binding to FcR. Otelixizumab (ChAglyCD3, TRX4, GSK2136525) was derived from the rat antibody YTH12.5. This humanized IgG1 bears a single mutation in the γ1 Fc portion to avoid glycosylation and thus inhibit FcR binding. Visilizumab (Nuvion, HuM291) is a humanized IgG2 antibody that is rendered non-mitogenic by two point mutations in its Fc region. Foralumab (28F11-AE; NI-0401) is an entirely human anti-CD3 mAb; the Fc portion of this human IgG1 was mutated such that the mAb is non FcR binding in vitro and exhibits only minor cytokine release in vivo while maintaining modulation of the CD3/TCR and T-cell depletion. Non-limiting examples of anti-CD3 antibodies are also disclosed in US 2016/0333095A1.

In certain embodiments, the anti-CD3 antigen binding domains described herein bind human CD3. In some instances, the anti-CD3 antigen binding domains described herein bind human CD3ε. In some embodiments, the anti-CD3 antigen binding domains described herein bind human CD3δ.

Exemplary Anti-CD3 Antigen Binding Domain Sequences

In various embodiments, the first antigen binding domain, targeting or binding to, or specifically binding to human CD3, comprises a first heavy chain variable domain (VH) and a first light chain variable domain (VL), comprising: (i) a first VH-complementarity determining region (CDR) 1 comprising the amino acid sequence of TYAMN (SEQ ID NO:1); (ii) a first VH-CDR2 comprising the amino acid sequence of RIRSKYNNYATYYAX$_1$SVKX$_2$, wherein X$_1$ is A or D and X$_2$ is G or S (SEQ ID NO:2); (iii) a first VH-CDR3 comprising the amino acid sequence of HGNFGX$_3$SYVSWFAY, wherein X$_3$ is H or N (SEQ ID NO:3); (iv) a first VL-CDR1 comprising the amino acid sequence of GSSTGAVTTGHYAN (SEQ ID NO: 4); (v) a first VL-CDR2 comprising the amino acid sequence of GTX$_4$X$_5$RAP, wherein X$_4$X$_5$ is SN or NK (SEQ ID NO:5); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to Kabat. In some embodiments, (i) the first VH-complementarity determining region (CDR) 1 comprises the amino acid sequence of TYAMN (SEQ ID NO:1); (ii) the first VH-CDR2 comprises the amino acid sequence of RIRSKYNNYATYYADSVKX$_2$, wherein X$_2$ is G or S (SEQ ID NO:7); (iii) the first VH-CDR3 comprises the amino acid sequence of HGNFGHSYVSWFAY (SEQ ID NO:8); (iv) the first VL-CDR1 comprises the amino acid sequence of GSSTGAVTTGHYAN (SEQ ID NO: 4); (v) the first VL-CDR2 comprises the amino acid sequence of GTSNRAP (SEQ ID NO:9); and (vi) the first VL-CDR3 comprises the amino acid sequence of ALWYSNRWV (SEQ ID NO:10). In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 1, 11, 8, 4, 5 and 10; SEQ ID NOs: 1, 11, 8, 4, 9 and 10; SEQ ID NOs: 1, 12, 8, 4, 9 and 10; SEQ ID NOs: 1, 13, 8, 4, 14 and 15; SEQ ID NOs: 1, 13, 16, 4, 14 and 15; or SEQ ID NOs: 1, 11, 8, 4, 14 and 10. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 1, 11, 8, 4, 9 and 10; or SEQ ID NOs: 1, 12, 8, 4, 9 and 10. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 1, 11, 8, 4, 9 and 10. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 1, 12, 8, 4, 9 and 10.

In various embodiments, the first antigen binding domain, targeting or binding to, or specifically binding to human CD3, comprises a first heavy chain variable domain (VH) and a first light chain variable domain (VL), comprising: (i) a first VH-CDR1 comprising the amino acid sequence of GFTFNTY (SEQ ID NO:17); (ii) a first VH-CDR2 comprising the amino acid sequence of SKYNNY (SEQ ID NO:18); (iii) a first VH-CDR3 comprising the amino acid sequence of GNFGX$_3$SYVSWFA, wherein X$_3$ is H or N (SEQ ID NO:19); (iv) a first VL-CDR1 comprising the amino acid sequence of SSTGAVTTGHY (SEQ ID NO: 20); (v) a first VL-CDR2 comprising the amino acid sequence of GTX$_4$, wherein X$_4$ is N or S (SEQ ID NO:21); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Chothia. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 17, 18, 23, 20, 21 and 25; SEQ ID NOs: 17, 18, 23, 20, 24 and 25; SEQ ID NOs: 17, 18, 23, 20, 26 and 27; SEQ ID NOs: 17, 18, 75, 20, 26 and 27; or SEQ ID NOs: 17, 18, 23, 20, 26 and 25. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 17, 18, 23, 20, 24 and 25.

In various embodiments, the first antigen binding domain, targeting or binding to, or specifically binding to human CD3, comprises a first heavy chain variable domain (VH) and a first light chain variable domain (VL), comprising: (i) a first VH-CDR1 comprising the amino acid sequence of GFTFNTYA (SEQ ID NO:28); (ii) a first VH-CDR2 comprising the amino acid sequence of IRSKYNNYAT (SEQ ID NO:29); (iii) a first VH-CDR3 comprising the amino acid sequence of VRHGNFGX$_3$SYVSWFAY, wherein X$_3$ is H or N (SEQ ID NO:30); (iv) a first VL-CDR1 comprising the amino acid sequence of TGAVTTGHY (SEQ ID NO:31); (v) a first VL-CDR2 comprising the amino acid sequence of GTX$_4$, wherein X$_4$ is N or S (SEQ ID NO:21); and (vi) a first VL-CDR3 comprising the amino acid sequence of ALWYSNX$_6$WV, wherein X$_6$ is L or R (SEQ ID NO:6), wherein the first VH-CDR1, the first VH-CDR2, the first VH-CDR3, the first VL-CDR1, the first VL-CDR2, and the first VH-CDR3 are according to IMGT. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 28, 29, 32, 31, 21 and 10; SEQ ID NOs: 28, 29, 32, 31, 24 and 10; SEQ ID NOs: 28, 29, 32, 31, 26 and 15; SEQ ID NOs: 28, 29, 33, 31, 26 and 15; or SEQ ID NOs: 28, 29, 32, 31, 26 and 10. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 28, 29, 32, 31, 24 and 10.

In various embodiments, the first antigen binding domain, targeting or binding to, or specifically binding to human CD3, comprises a first heavy chain variable domain (VH) and a first light chain variable domain (VL), comprising: (i) a first VH-CDR1 comprising the amino acid sequence of ASGFTFNTYA (SEQ ID NO:34); (ii) a first VH-CDR2 comprising the amino acid sequence of IRSKYNNYATYYAX$_1$SVKX$_2$R, wherein X$_1$ is A or D and X$_2$ is G or S (SEQ ID NO:35); (iii) a first VH-CDR3 comprising the amino acid sequence of HGNFGX$_3$SYVSWFA, X$_3$ is H or N (SEQ ID NO:36); (iv) a first VL-CDR1 comprising the amino acid sequence of SSTGAVTTGHY (SEQ ID NO: 37); (v) a first VL-CDR2 comprising the amino acid sequence of GTX$_4$NRAPX$_7$VPAR, wherein X$_4$ is N or S and X$_7$ is G or W (SEQ ID NO:38); and (vi) a first VL-CDR3 comprising the amino acid sequence of WYSNX$_6$W, wherein X$_6$ is L or R (SEQ ID NO:22), wherein the first VH-CDR1, the first VH-CDR2, the first VH-CDR3, the first VL-CDR1, the first VL-CDR2, and the first VH-CDR3 are according to Honegger. In some embodiments, (i) the first VH-CDR1 comprises the amino acid sequence of ASGFTFNTYA (SEQ ID NO:34); (ii) the first VH-CDR2 comprises the amino acid sequence of IRSKYNNYATYYADSVKX$_2$R, wherein X$_2$ is G or S (SEQ ID NO:39);
(iii) the first VH-CDR3 comprises the amino acid sequence of HGNFGHSYVSWFA (SEQ ID NO:40); (iv) the first VL-CDR1 comprises the amino acid sequence of SSTGAVTTGHY (SEQ ID NO: 37); (v) the first VL-CDR2 comprises the amino acid sequence of GTSNRAPGVPAR (SEQ ID NO:41); and (vi) the first VL-CDR3 comprises the amino acid sequence of WYSNRW (SEQ ID NO:25). In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 34, 39, 40, 37, 41 and 25; SEQ ID NOs: 34, 42, 40, 37, 41 and 25; SEQ ID NOs: 34, 43, 40, 37, 41 and 25; SEQ ID NOs: 34, 44, 40, 37, 45 and 27; SEQ ID NOs: 34, 44, 46, 37, 45 and 27; or SEQ ID NOs: 34, 42, 40, 37, 47 and 25. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 34, 42, 40, 37, 41 and 25; or SEQ ID NOs: 34, 43, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 34, 42, 40, 37, 41 and 25. In some embodiments, the first VH-CDR1, the first VH-CDR2, the first VH-CDR3, the first VL-CDR1, the first VL-CDR2 and the first VL-CDR3 comprise the following amino acid sequences, respectively: SEQ ID NOs: 34, 43, 40, 37, 41 and 25.

Illustrative sequences of complementarity determining regions (CDRs) of exemplary first antigen binding domains of the multi-specific antigen binding molecules, targeting human CD3, according to the Kabat definition, the Chothia definition, the IMGT definition and Honegger definition are provided in Tables A1, A2, A3 and A4, respectively. Multi-specific antigen binding molecules comprising the CDRs identified herein are encompassed by the present application. It is to be understood that this disclosure also encompasses multi-specific antigen binding molecules (e.g., anti-CD3/anti-HIV antigen bi-specific antibodies) comprising the CDRs according to any other CDR definition (e.g., Honegger definition, enhanced Chothia definition, Martin definition, Gelfand definition, AbM definition, contact definition, see, e.g., bioinf.org.uk/abs/#cdrdef and Dondelinger, et al., *Front Immunol*. (2018) 9:2278) of the anti-CD3/anti-HIV multi-specific antigen binding molecules disclosed herein.

TABLE A1

| CDRs for anti-CD3 binding arm (Kabat) | | | | | | |
|---|---|---|---|---|---|---|
| Ab Name | VH - CDR1 | VH - CDR2 | VH - CDR3 | VL - CDR1 | VL - CDR2 | VL - CDR3 |
| 400 | TYAMN SEQ ID NO: 1 | RIRSKYNNYATYYAX$_1$SVKX$_2$ X$_1$ is A or D X$_2$ is G or S SEQ ID NO: 2 | HGNFGX$_3$SYVSWFAY X$_3$ is H or N SEQ ID NO: 3 | GSSTGAVTTGHYAN SEQ ID NO: 4 | GTX$_4$X$_5$RAP X$_4$X$_5$ is SN or NK SEQ ID NO: 5 | ALWYSNX$_6$WV X$_6$ is L or R SEQ ID NO: 6 |

TABLE A1-continued

CDRs for anti-CD3 binding arm (Kabat)

| Ab Name | VH-CDR1 | VH-CDR2 | VH-CDR3 | VL-CDR1 | VL-CDR2 | VL-CDR3 |
|---|---|---|---|---|---|---|
| 401 | TYAMN SEQ ID NO: 1 | RIRSKYNNYATYYADSVKX$_2$ X$_2$ is G or S SEQ ID NO: 7 | HGNFGHSYVSWFAY SEQ ID NO: 8 | GSSTGAVTTGHYAN SEQ ID NO: 4 | GTSNRAP SEQ ID NO: 9 | ALWYSNRWV SEQ ID NO: 10 |
| 402 | TYAMN SEQ ID NO: 1 | RIRSKYNNYATYYADSVKG SEQ ID NO: 11 | HGNFGHSYVSWFAY SEQ ID NO: 8 | GSSTGAVTTGHYAN SEQ ID NO: 4 | GTX$_4$X$_5$RAP X$_4$X$_5$ is SN or NK SEQ ID NO: 5 | ALWYSNRWV SEQ ID NO: 10 |
| 403 | TYAMN SEQ ID NO: 1 | RIRSKYNNYATYYADSVKG SEQ ID NO: 11 | HGNFGHSYVSWFAY SEQ ID NO: 8 | GSSTGAVTTGHYAN SEQ ID NO: 4 | GTSNRAP SEQ ID NO: 9 | ALWYSNRWV SEQ ID NO: 10 |
| 404 | TYAMN SEQ ID NO: 1 | RIRSKYNNYATYYADSVKS SEQ ID NO: 12 | HGNFGHSYVSWFAY SEQ ID NO: 8 | GSSTGAVTTGHYAN SEQ ID NO: 4 | GTSNRAP SEQ ID NO: 9 | ALWYSNRWV SEQ ID NO: 10 |
| 405 | TYAMN SEQ ID NO: 1 | RIRSKYNNYATYYAASVKG SEQ ID NO: 13 | HGNFGHSYVSWFAY SEQ ID NO: 8 | GSSTGAVTTGHYAN SEQ ID NO: 4 | GTNKRAP SEQ ID NO: 14 | ALWYSNLWV SEQ ID NO: 15 |
| 406 | TYAMN SEQ ID NO: 1 | RIRSKYNNYATYYAASVKG SEQ ID NO: 13 | HGNFGNSYVSWFAY SEQ ID NO: 16 | GSSTGAVTTGHYAN SEQ ID NO: 4 | GTNKRAP SEQ ID NO: 14 | ALWYSNLWV SEQ ID NO: 15 |
| 407 | TYAMN SEQ ID NO: 1 | RIRSKYNNYATYYADSVKG SEQ ID NO: 11 | HGNFGHSYVSWFAY SEQ ID NO: 8 | GSSTGAVTTGHYAN SEQ ID NO: 4 | GTNKRAP SEQ ID NO: 14 | ALWYSNRWV SEQ ID NO: 10 |

TABLE A2

CDRs for anti-CD3 binding arm (Chothia)

| Ab Name | VH-CDR1 | VH-CDR2 | VH-CDR3 | VL-CDR1 | VL-CDR2 | VL-CDR3 |
|---|---|---|---|---|---|---|
| 408 | GFTFNTY SEQ ID NO: 17 | SKYNNY SEQ ID NO: 18 | GNFGX$_3$SYVSWFA X$_3$ is H or N SEQ ID NO: 19 | SSTGAVTTGHY SEQ ID NO: 20 | GTX$_4$ X$_4$ is N or S SEQ ID NO: 21 | WYSNX$_6$W X$_6$ is L or R SEQ ID NO: 22 |
| 409 | GFTFNTY SEQ ID NO: 17 | SKYNNY SEQ ID NO: 18 | GNFGHSYVSWFA SEQ ID NO: 23 | SSTGAVTTGHY SEQ ID NO: 20 | GTX$_4$ X$_4$ is N or S SEQ ID NO: 21 | WYSNRW SEQ ID NO: 25 |
| 410 | GFTFNTY SEQ ID NO: 17 | SKYNNY SEQ ID NO: 18 | GNFGHSYVSWFA SEQ ID NO: 23 | SSTGAVTTGHY SEQ ID NO: 20 | GTS SEQ ID NO: 24 | WYSNRW SEQ ID NO: 25 |
| 411 | GFTFNTY SEQ ID NO: 17 | SKYNNY SEQ ID NO: 18 | GNFGHSYVSWFA SEQ ID NO: 23 | SSTGAVTTGHY SEQ ID NO: 20 | GTN SEQ ID NO: 26 | WYSNLW SEQ ID NO: 27 |
| 412 | GFTFNTY SEQ ID NO: 17 | SKYNNY SEQ ID NO: 18 | GNFGNSYVSWFA SEQ ID NO: 75 | SSTGAVTTGHY SEQ ID NO: 20 | GTN SEQ ID NO: 26 | WYSNLW SEQ ID NO: 27 |
| 413 | GFTFNTY SEQ ID NO: 17 | SKYNNY SEQ ID NO: 18 | GNFGHSYVSWFA SEQ ID NO: 23 | SSTGAVTTGHY SEQ ID NO: 20 | GTN SEQ ID NO: 26 | WYSNRW SEQ ID NO: 25 |

TABLE A3

CDRs for anti-CD3 binding arm (IMGT)

| Ab Name | VH - CDR1 | VH - CDR2 | VH - CDR3 | VL - CDR1 | VL - CDR2 | VL - CDR3 |
|---|---|---|---|---|---|---|
| 414 | GFTFNTYA SEQ ID NO: 28 | IRSKYNNYAT SEQ ID NO: 29 | VRHGNFG$X_3$SYVSWFAY $X_3$ is H or N SEQ ID NO: 30 | TGAVTTGHY SEQ ID NO: 31 | GT$X_4$ $X_4$ is N or S SEQ ID NO: 21 | ALWYSN$X_6$WV $X_6$ is L or R SEQ ID NO: 6 |
| 415 | GFTFNTYA SEQ ID NO: 28 | IRSKYNNYAT SEQ ID NO: 29 | VRHGNFGHSYVSWFAY SEQ ID NO: 32 | TGAVTTGHY SEQ ID NO: 31 | GT$X_4$ $X_4$ is N or S SEQ ID NO: 21 | ALWYSNRWV SEQ ID NO: 10 |
| 416 | GFTFNTYA SEQ ID NO: 28 | IRSKYNNYAT SEQ ID NO: 29 | VRHGNFGHSYVSWFAY SEQ ID NO: 32 | TGAVTTGHY SEQ ID NO: 31 | GTS SEQ ID NO: 24 | ALWYSNRWV SEQ ID NO: 10 |
| 417 | GFTFNTYA SEQ ID NO: 28 | IRSKYNNYAT SEQ ID NO: 29 | VRHGNFGHSYVSWFAY SEQ ID NO: 32 | TGAVTTGHY SEQ ID NO: 31 | GTN SEQ ID NO: 26 | ALWYSNLWV SEQ ID NO: 15 |
| 418 | GFTFNTYA SEQ ID NO: 28 | IRSKYNNYAT SEQ ID NO: 29 | VRHGNFGNSYVSWFAY SEQ ID NO: 33 | TGAVTTGHY SEQ ID NO: 31 | GTN SEQ ID NO: 26 | ALWYSNLWV SEQ ID NO: 15 |
| 419 | GFTFNTYA SEQ ID NO: 28 | IRSKYNNYAT SEQ ID NO: 29 | VRHGNFGHSYVSWFAY SEQ ID NO: 32 | TGAVTTGHY SEQ ID NO: 31 | GTN SEQ ID NO: 26 | ALWYSNRWV SEQ ID NO: 10 |

TABLE A4

CDRs for anti-CD3 binding arm (Honegger)

| Ab Name | VH - CDR1 | VH - CDR2 | VH - CDR3 | VL - CDR1 | VL - CDR2 | VL - CDR3 |
|---|---|---|---|---|---|---|
| 420 | ASGFTFNTYA SEQ ID NO: 34 | IRSKYNNYATYYA$X_1$SVK$X_2$R $X_1$ is A or D $X_2$ is G or S SEQ ID NO: 35 | HGNFG$X_3$SYVSWFA $X_3$ is H or N SEQ ID NO: 36 | SSTGAVTTGHY SEQ ID NO: 37 | GT$X_4$NRAP$X_7$VPAR $X_4$ is N or S $X_7$ is G or W SEQ ID NO: 38 | WYSN$X_6$W $X_6$ is L or R SEQ ID NO: 22 |
| 421 | ASGFTFNTYA SEQ ID NO: 34 | IRSKYNNYATYYADSVK$X_2$R $X_2$ is G or S SEQ ID NO: 39 | HGNFGHSYVSWFA SEQ ID NO: 40 | SSTGAVTTGHY SEQ ID NO: 37 | GTSNRAPGVPAR SEQ ID NO: 41 | WYSNRW SEQ ID NO: 25 |
| 422 | ASGFTFNTYA SEQ ID NO: 34 | IRSKYNNYATYYADSVK$X_2$R $X_2$ is G or S SEQ ID NO: 39 | HGNFGHSYVSWFA SEQ ID NO: 40 | SSTGAVTTGHY SEQ ID NO: 37 | GTSNRAPGVPAR SEQ ID NO: 41 | WYSNRW SEQ ID NO: 25 |
| 423 | ASGFTFNTYA SEQ ID NO: 34 | IRSKYNNYATYYADSVKGR SEQ ID NO: 42 | HGNFGHSYVSWFA SEQ ID NO: 40 | SSTGAVTTGHY SEQ ID NO: 37 | GTSNRAPGVPAR SEQ ID NO: 41 | WYSNRW SEQ ID NO: 25 |
| 424 | ASGFTFNTYA SEQ ID NO: 34 | IRSKYNNYATYYADSVKSR SEQ ID NO: 43 | HGNFGHSYVSWFA SEQ ID NO: 40 | SSTGAVTTGHY SEQ ID NO: 37 | GTSNRAPGVPAR SEQ ID NO: 41 | WYSNRW SEQ ID NO: 25 |
| 425 | ASGFTFNTYA SEQ ID NO: 34 | IRSKYNNYATYYAASVKGR SEQ ID NO: 44 | HGNFGHSYVSWFA SEQ ID NO: 40 | SSTGAVTTGHY SEQ ID NO: 37 | GTNKRAPWTPAR SEQ ID NO: 45 | WYSNLW SEQ ID NO: 27 |
| 426 | ASGFTFNTYA SEQ ID NO: 34 | IRSKYNNYATYYAASVKGR SEQ ID NO: 44 | HGNFGNSYVSWFA SEQ ID NO: 46 | SSTGAVTTGHY SEQ ID NO: 37 | GTNKRAPWTPAR SEQ ID NO: 45 | WYSNLW SEQ ID NO: 27 |
| 427 | ASGFTFNTYA SEQ ID NO: 34 | IRSKYNNYATYYADSVKGR SEQ ID NO: 42 | HGNFGHSYVSWFA SEQ ID NO: 40 | SSTGAVTTGHY SEQ ID NO: 37 | GTNKRAPGVPAR SEQ ID NO: 47 | WYSNRW SEQ ID NO: 25 |

Additionally, it has been reported that heavy chain variable domains derived from VH3 family germlines can exhibit direct binding to Protein A affinity chromatography resins (Bach, et al., J Chromatogr A. (2015) 1409:60-9). Accordingly, in certain embodiments, to reduce, or substantially or completely eliminate, binding to Protein A by one heavy chain-containing subunit of a multi-specific or bispecific antigen binding molecule, a H435R or H435R+Y436F mutation in the Fc region of the first or second heavy chain can be combined with one or more amino acid substitutions in the VH of the same heavy chain, should that VH region be derived from a human VH3 family germline. In some embodiments, the first VH (and/or a second VH derived from a human VH3 family germline) comprises one or more of the following amino acids at the indicated positions (as described herein, numbering of amino acid positions for substitutions in the first and second VH and VL regions is according to Kabat): the position corresponding to 19 is A, S, T or K; the position corresponding to 57 is A, E or T; the position corresponding to 65 is G, S or T; the position corresponding to 81 is E, K or T; and the position corresponding to 82a is S, T or R. In some embodiments, the first (and/or a second VH derived from a human VH3 family germline) VH comprises one or more of the following amino acids at the indicated positions (position numbering according to Kabat): the position corresponding to 19 is A or S; the position corresponding to 57 is A or E; the position corresponding to 65 is S; and the position corresponding to 81 is E. In some embodiments, the first VH (and/or a second VH derived from a human VH3 family germline) comprises one or more of the following amino acids at the indicated positions (position numbering according to Kabat): the position corresponding to 19 is S and the position corresponding to 57 is A; the position corresponding to 19 is A or S and the position corresponding to 57 is E; the position corresponding to 19 is A and the position corresponding to 57 is E; the position corresponding to 19 is S and the position corresponding to 57 is E; the position corresponding to 19 is S and the position corresponding to 65 is S; the position corresponding to 19 is S and the position corresponding to 81 is E; the position corresponding to 19 is K and the position corresponding to 81 is E; the position corresponding to 57 is A and the position corresponding to 81 is E; the position corresponding to 57 is A and the position corresponding to 65 is S; the position corresponding to 57 is E and the position corresponding to 65 is S; the position corresponding to 57 is E and the position corresponding to 81 is E; the position corresponding to 65 is S and the position corresponding to 81 is E; or the position corresponding to 81 is E and the position corresponding to 82a is S.

In some embodiments, the first antigen binding domain has reduced or insignificant or substantially no binding to Protein A, or does not detectably bind to Protein A. In some embodiments, the first antigen binding domain binds to Protein A with a $K_D$ of greater than $10^{-6}$ M. Protein binding affinity can be determined by any method known in the art, e.g., by surface plasmon resonance (SPR), e.g., using Octet as described herein.

As used herein, numbering of a given amino acid polymer or nucleic acid polymer "corresponds to", is "corresponding to" or is "relative to" the numbering of a selected or reference amino acid polymer or nucleic acid polymer when the position of any given polymer component (e.g., amino acid, nucleotide, also referred to generically as a "residue") is designated by reference to the same or to an equivalent position (e.g., based on an optimal alignment or a consensus sequence) in the selected amino acid or nucleic acid polymer, rather than by the actual numerical position of the component in the given polymer.

In some embodiments, the first VH and the first VL comprise one or more of the following amino acid substitutions (numbering according to Kabat): position 81 of the first VH is Q or E; position 83 of the first VH is K or R; position 89 of the first VH is M or V; position 100 of the first VH is H; position 57 of the first VL is G or W; and/or position 75 of the first VL is I or L. In some embodiments, position 81 of the first VH is Q or E. In some embodiments, position 81 of the first VH is E. In some embodiments, position 81 of the first VH is Q. In some embodiments, one or more of position 81 of the first VH is Q or E; position 83 of the first VH is R; position 89 of the first VH is V; position 100 of the first VH is H; position 57 of the first VL is G; and/or position 75 of the first VL is I.

In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence selected from the group consisting of SEQ ID NOs: 48-53. In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 50. In some embodiments, the first VH comprises the amino acid sequence of SEQ ID NO: 50. In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 51. In some embodiments, the first VH comprises the amino acid sequence of SEQ ID NO: 51. In some embodiments, the first VL comprises an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence of SEQ ID NO: 54-58. In some embodiments, the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VL comprises the amino acid sequence of SEQ ID NO: 56. In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence selected from the group consisting of SEQ ID NOs: 48-53 and wherein the first VL comprises an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence of SEQ ID NO: 54-58.

In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 50 and wherein the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VH comprises the amino acid sequence of SEQ ID NO: 50 and the first VL comprises an amino acid sequence that is at least 95% identical to the amino acid sequence of SEQ ID NO: 56. In some embodiments, the first VH comprises the amino acid sequence of SEQ ID NO: 50 and the first VL comprises an amino acid sequence that is at least 96% identical to the amino acid sequence of SEQ ID NO: 56. In some embodiments, the first VH comprises the amino acid sequence of SEQ ID NO: 50 and the first VL comprises an amino acid sequence that is at least 97% identical to the amino acid sequence of SEQ ID NO: 56. In some embodiments, the first VH comprises the amino acid sequence of SEQ ID NO: 50 and the first VL comprises an amino acid sequence that is at least 98% identical to the amino acid sequence of SEQ ID NO: 56. In some embodiments, the first VH comprises the amino acid sequence of SEQ ID NO: 50 and the first VL comprises an amino acid sequence that is at least 99% identical to the amino acid sequence of SEQ ID NO: 56. In some embodiments, the first VH comprises an amino acid sequence that is at least 95% identical to the amino acid sequence of SEQ ID NO: 50 and the first VL comprises the amino acid sequence of SEQ ID NO: 56. In some embodiments, the first VH comprises an amino acid sequence that is at least 96% identical to the amino acid sequence of SEQ ID NO: 50 and the first VL comprises the amino acid sequence of SEQ ID NO: 56. In some embodiments, the first VH comprises an amino acid sequence that is at least 97% identical to the amino acid sequence of SEQ ID NO: 50 and the first VL comprises the amino acid sequence of SEQ ID NO: 56. In some embodiments, the first VH comprises an amino acid sequence that is at least 98% identical to the amino acid sequence of SEQ ID NO: 50 and the first VL comprises the amino acid sequence of SEQ ID NO: 56. In some embodiments, the first VH comprises an amino acid sequence that is at least 99% identical to the amino acid sequence of SEQ ID NO: 50 and the first VL comprises the amino acid sequence of SEQ ID NO: 56.

In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 51 and wherein the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VH comprises the amino acid sequence of SEQ ID NO: 51 and the first VL comprises an amino acid sequence that is at least 95% identical to the amino acid sequence of SEQ ID NO: 56. In some embodiments, the first VH comprises the amino acid sequence of SEQ ID NO: 51 and the first VL comprises an amino acid sequence that is at least 96% identical to the amino acid sequence of SEQ ID NO: 56. In some embodiments, the first VH comprises the amino acid sequence of SEQ ID NO: 51 and the first VL comprises an amino acid sequence that is at least 97% identical to the amino acid sequence of SEQ ID NO: 56. In some embodiments, the first VH comprises the amino acid sequence of SEQ ID NO: 51 and the first VL comprises an amino acid sequence that is at least 98% identical to the amino acid sequence of SEQ ID NO: 56. In some embodiments, the first VH comprises the amino acid sequence of SEQ ID NO: 51 and the first VL comprises an amino acid sequence that is at least 99% identical to the amino acid sequence of SEQ ID NO: 56. In some embodiments, the first VH comprises an amino acid sequence that is at least 95% identical to the amino acid sequence of SEQ ID NO: 51 and the first VL comprises the amino acid sequence of SEQ ID NO: 56. In some embodiments, the first VH comprises an amino acid sequence that is at least 96% identical to the amino acid sequence of SEQ ID NO: 51 and the first VL comprises the amino acid sequence of SEQ ID NO: 56. In some embodiments, the first VH comprises an amino acid sequence that is at least 97% identical to the amino acid sequence of SEQ ID NO: 51 and the first VL comprises the amino acid sequence of SEQ ID NO: 56. In some embodiments, the first VH comprises an amino acid sequence that is at least 98% identical to the amino acid sequence of SEQ ID NO: 51 and the first VL comprises the amino acid sequence of SEQ ID NO: 56. In some embodiments, the first VH comprises an amino acid sequence that is at least 99% identical to the amino acid sequence of SEQ ID NO: 51 and the first VL comprises the amino acid sequence of SEQ ID NO: 56.

In various embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 48 and 54; SEQ ID NOs: 49 and 55; SEQ ID NOs: 50 and 55; SEQ ID NOs: 50 and 56; SEQ ID NOs: 51 and 55; SEQ ID NOs: 51 and 56; SEQ ID NOs: 52 and 56; SEQ ID NOs: 53 and 57; or SEQ ID NOs: 50 and 58. In various embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56. In various embodiments, the first VH and the first VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 50 and 56; or SEQ ID NOs: 51 and 56. In some embodiments, position 100 of the first VH (numbering according to Kabat) is a histidine (H).

In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 50 and wherein the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VH comprises the amino acid sequence of SEQ ID NO: 50 and the first VL comprises an amino acid sequence that is at least 95% identical to the amino acid sequence of SEQ ID NO: 56. In some embodiments, the first VH comprises the amino acid sequence of SEQ ID NO: 50 and the first VL comprises an amino acid sequence that is at least 96% identical to the amino acid sequence of SEQ ID NO: 56. In some embodiments, the first VH comprises the amino acid sequence of SEQ ID NO: 50 and the first VL comprises an amino acid sequence that is at least 97% identical to the amino acid sequence of SEQ ID NO: 56. In some embodiments, the first VH comprises the amino acid sequence of SEQ ID NO: 50 and the first VL comprises an amino acid sequence that is at least 98% identical to the amino acid sequence of SEQ ID NO: 56. In some embodiments, the first VH comprises the amino acid sequence of SEQ ID NO: 50 and the first VL comprises an amino acid sequence that is at least 99% identical to the amino acid sequence of SEQ ID NO: 56. In some embodiments, the first VH comprises an amino acid sequence that is at least 95% identical to the amino acid sequence of SEQ ID NO: 50 and the first VL comprises the amino acid sequence of SEQ ID NO: 56. In some embodiments, the first VH comprises an amino acid sequence that is at least 96% identical to the amino acid sequence of SEQ ID NO: 50 and the first VL comprises the amino acid sequence of SEQ ID NO: 56. In some embodiments, the first VH comprises an amino acid sequence that is at least 97% identical to the amino acid sequence of SEQ ID NO: 50 and the first VL comprises the amino acid sequence of SEQ ID NO: 56. In some embodiments, the first VH comprises an amino acid sequence that is at least 98% identical to the amino acid sequence of SEQ ID NO: 50 and the first VL comprises the amino acid sequence of SEQ ID NO: 56. In some embodiments, the first VH comprises an amino acid sequence that is at least 99% identical to the amino acid sequence of SEQ ID NO: 50 and the first VL comprises the amino acid sequence of SEQ ID NO: 56. In some embodiments, the first VH and the first VL comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 50 and 56. In some embodiments, the first VH and the first VL comprise amino acid sequences that are at least 95% identical to the amino acid sequences set forth, respectively: SEQ ID NOs: 50 and 56. In some embodiments, the first VH and the first VL comprise amino acid sequences that are at least 99% identical to the amino acid sequences set forth, respectively: SEQ ID NOs: 50 and 56. In some embodiments, the first VH and the first VL comprise the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 11, 8, 4, 9 and 10, and the first VH and the first VL comprise amino acid sequences that are at least 95% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 11, 8, 4, 9 and 10, and the first VH and the first VL comprise amino acid sequences that are at least 99% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): SEQ ID NOs: 17, 18, 23, 20, 24 and 25, and the first VH and the first VL comprise amino acid sequences that are at least 95% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): SEQ ID NOs: 17, 18, 23, 20, 24 and 25, and the first VH and the first VL comprise amino acid sequences that are at least 99% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): SEQ ID NOs: 28, 29, 32, 31, 24 and 10, and the first VH and the first VL comprise amino acid sequences that are at least 95% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): SEQ ID NOs: 28, 29, 32, 31, 24 and 10, and the first VH and the first VL comprise amino acid sequences that are at least 99% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 42, 40, 37, 41 and 25, and the first VH and the first VL comprise amino acid sequences that are at least 95% identical to the amino acid sequences set forth, respectively: SEQ ID NOs: 50 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 42, 40, 37, 41 and 25, and the first VH and the first VL comprise amino acid sequences that are at least 99% identical to the amino acid sequences set forth, respectively: SEQ ID NOs: 50 and 56.

In some embodiments, the first VH comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 51 and wherein the first VL comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 56. In some embodiments, the first VH comprises the amino acid sequence of SEQ ID NO: 51 and the first VL comprises an amino acid sequence that is at least 95% identical to the amino acid sequence of SEQ ID NO: 56. In some embodiments, the first VH comprises the amino acid sequence of SEQ ID NO: 51 and the first VL comprises an amino acid sequence that is at least 96% identical to the amino acid sequence of SEQ ID NO: 56. In some embodiments, the first VH comprises the amino acid sequence of SEQ ID NO: 51 and the first VL comprises an amino acid sequence that is at least 97% identical to the amino acid sequence of SEQ ID NO: 56. In some embodiments, the first VH comprises the amino acid sequence of SEQ ID NO: 51 and the first VL comprises an amino acid sequence that is at least 98% identical to the amino acid sequence of SEQ ID NO: 56. In some embodiments, the first VH comprises the amino acid sequence of SEQ ID NO: 51 and the first VL comprises an amino acid sequence that is at least 99% identical to the amino acid sequence of SEQ ID NO: 56. In some embodiments, the first VH comprises an amino acid sequence that is at least 95% identical to the amino acid sequence of SEQ ID NO: 51 and the first VL comprises the amino acid sequence of SEQ ID NO: 56. In some embodiments, the first VH comprises an amino acid sequence that is at least 96% identical to the amino acid sequence of SEQ ID NO: 51 and the first VL comprises the amino acid sequence of SEQ ID NO: 56. In some embodiments, the first VH comprises an amino acid sequence that is at least 97% identical to the amino acid sequence of SEQ ID NO: 51 and the first VL comprises the amino acid sequence of SEQ ID NO: 56. In some embodiments, the first VH comprises an amino acid sequence that is at least 98% identical to the amino acid sequence of SEQ ID NO: 51 and the first VL comprises the amino acid sequence of SEQ ID NO: 56. In some embodiments, the first VH comprises an amino acid sequence that is at least 99% identical to the amino acid sequence of SEQ ID NO: 51 and the first VL comprises the amino acid sequence of SEQ ID NO: 56. In some embodiments, the first VH and the first VL comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56. In some embodiments, the first VH and the first VL comprise amino acid sequences that are at least 95% identical to the amino acid sequences set forth, respectively: SEQ ID NOs: 51 and 56. In some embodiments, the first VH and the first VL comprise amino acid sequences that are at least 99% identical to the amino acid sequences set forth, respectively: SEQ ID NOs: 51 and 56. In some embodiments, the first VH and the first VL comprise the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 12, 8, 4, 9 and 10, and the first VH and the first VL comprise amino acid sequences that are at least 95% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Kabat): SEQ ID NOs: 1, 12, 8, 4, 9 and 10, and the first VH and the first VL comprise amino acid sequences that are at least 99% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): SEQ ID NOs: 17, 18, 23, 20, 24 and 25, and the first VH and the first VL comprise amino acid sequences that are at least 95% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Chothia): SEQ ID NOs: 17, 18, 23, 20, 24 and 25, and the first VH and the first VL comprise amino acid sequences that are at least 99% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): SEQ ID NOs: 28, 29, 32, 31, 24 and 10, and the first VH and the first VL comprise amino acid sequences that are at least 95% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to IMGT): SEQ ID NOs: 28, 29, 32, 31, 24 and 10, and the first VH and the first VL comprise amino acid sequences that are at least 99% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 43, 40, 37, 41 and 25, and the first VH and the first VL comprise amino acid sequences that are at least 95% identical to the amino acid sequences set forth, respectively: SEQ ID NOs: 51 and 56. In some embodiments, the first VH-CDR1, the first VH-CDR2, the first VH-CDR3, the first VL-CDR1, the first VL-CDR2 and the first VL-CDR3 comprise the following amino acid sequences, respectively (according to Honegger): SEQ ID NOs: 34, 43, 40, 37, 41 and 25, and the first VH and the first VL comprise amino acid sequences that are at least 99% identical to the amino acid sequences set forth, respectively: SEQ ID NOs: 51 and 56.

Illustrative sequences of the VH and VL of the first antigen binding domains of the multi-specific antigen binding molecules, targeting human CD3, are provided in Tables B1 and B2.

TABLE B1

| SEQ ID NO: | anti-CD3 binding HC variable regions (VH) |
|---|---|
| 48 | EVQLVESGGGLVQPGGSLRLSCAASGFTFNTYAMNWVRQAPGKGL EWVGRIRSKYNNYATYYAX$_1$SVKX$_2$RFTISRDDSKNSLYLX$_8$MNSL X$_9$TEDTAX$_{10}$YYCVRHGNFGX$_3$SYVSWFAYWGQGTLVTVSS<br>X$_1$ is A or D;<br>X$_2$ is G or S;<br>X$_3$ is H or N;<br>X$_8$ is E or Q;<br>X$_9$ is K or R; and<br>X$_{10}$ is M or V |
| 49 | EVQLVESGGGLVQPGGSLRLSCAASGFTFNTYAMNWVRQAPGKGL EWVGRIRSKYNNYATYYADSVKX$_2$RFTISRDDSKNSLYLX$_8$MNSL RTEDTAVYYCVRHGNFGHSYVSWFAYWGQGTLVTVSS<br>X$_2$ is G or S; and<br>X$_8$ is E or Q |
| 50<br>VH3 | EVQLVESGGGLVQPGGSLRLSCAASGFTFNTYAMNWVRQAPGKG LEWVGRIRSKYNNYATYYADSVKGRFTISRDDSKNSLYLQMNSL RTEDTAVYYCVRHGNFGHSYVSWFAYWGQGTLVTVSS |
| 51<br>VH39 | EVQLVESGGGLVQPGGSLRLSCAASGFTFNTYAMNWVRQAPGKG LEWVGRIRSKYNNYATYYADSVKSRFTISRDDSKNSLYLEMNSL RTEDTAVYYCVRHGNFGHSYVSWFAYWGQGTLVTVSS |
| 52<br>VH34 | EVQLVESGGGLVQPGGSLRLSCAASGFTFNTYAMNWVRQAPGKG LEWVGRIRSKYNNYATYYAASVKGRFTISRDDSKNSLYLQMNSL KTEDTAMYYCVRHGNFGHSYVSWFAYWGQGTLVTVSS |
| 53<br>VH1 | EVQLVESGGGLVQPGGSLRLSCAASGFTFNTYAMNWVRQAPGKG LEWVGRIRSKYNNYATYYAASVKGRFTISRDDSKNSLYLQMNSL KTEDTAMYYCVRHGNFGNSYVSWFAYWGQGTLVTVSS |

TABLE B2

| SEQ ID NO: | anti-CD3 binding LC variable regions (VL) |
|---|---|
| 54 | QAVVTQEPSLTVSPGGIVTLICGSSTGAVTTGHYANWVQQKPGQA PRGLIGGTX$_4$X$_5$RAPX$_7$VPARFSGSLLGGKAALTX$_{11}$SGAQPEDE AEYYCALWYSNX$_6$WVFGGGTKLTVL<br>X$_4$X$_5$ is SN or NK;<br>X$_6$ is L or R;<br>X$_7$ is G or W; and<br>X$_{11}$ is I or L |

TABLE B2-continued

| SEQ ID NO: | anti-CD3 binding LC variable regions (VL) |
|---|---|
| 55 | QAVVTQEPSLTVSPGGIVTLICGSSTGAVTTGHYANWVQQKPGQA PRGLIGGTX$_4$X$_5$RAPGVPARFSGSLLGGKAALTISGAQPEDEAEY YCALWYSNRWVFGGGTKLTVL<br>X$_4$X$_5$ is SN or NK |
| 56<br>VL13 | QAVVTQEPSLTVSPGGTVTLTCGSSTGAVTTGHYANWVQQKPGQA PRGLIGGTSNRAPGVPARFSGSLLGGKAALTISGAQPEDEAEYY CALWYSNRWVFGGGTKLTVL |
| 57<br>VL3 | QAVVTQEPSLTVSPGGTVTLTCGSSTGAVTTGHYANWVQQKPGQA PRGLIGGTNKRAPWTPARFSGSLLGGKAALTLSGAQPEDEAEYYC ALWYSNLWVFGGGTKLTVL |
| 58<br>VL8 | QAVVTQEPSLTVSPGGTVTLTCGSSTGAVTTGHYANWVQQKPGQA PRGLIGGTNKRAPGVPARFSGSLLGGKAALTISGAQPEDEAEYYC ALWYSNRWVFGGGTKLTVL |

"Homology" or "identity" or "similarity" as used herein in the context of nucleic acids and polypeptides refers to the relationship between two polypeptides or two nucleic acid molecules based on an alignment of the amino acid sequences or nucleic acid sequences, respectively. Homology and identity can each be determined by comparing a position in each sequence which may be aligned for purposes of comparison. When an equivalent position in the compared sequences is occupied by the same base or amino acid, then the molecules are identical at that position; when the equivalent site occupied by the same or a similar amino acid residue (e.g., similar in steric and/or electronic nature), then the molecules can be referred to as homologous (similar) at that position. Expression as a percentage of homology/similarity or identity refers to a function of the number of identical or similar amino acids at positions shared by the compared sequences. In comparing two sequences, the absence of residues (amino acids or nucleic acids) or presence of extra residues also decreases the identity and homology/similarity.

As used herein, "identity" means the percentage of identical nucleotide or amino acid residues at corresponding positions in two or more sequences when the sequences are aligned to maximize sequence matching, i.e., taking into account gaps and insertions. Sequences are generally aligned for maximum correspondence over a designated region, e.g., a region at least 20, 25, 30, 35, 40, 45, 50, 55, 60, 65 or more amino acids or nucleotides in length, and can be up to the full length of the reference polypeptide or polynucleotide sequence. For sequence comparison, typically one sequence acts as a reference sequence, to which test sequences are compared. When using a sequence comparison algorithm, test and reference sequences are input into a computer program, subsequence coordinates are designated, if necessary, and sequence algorithm program parameters are designated. Otherwise, standard parameters can be used. The sequence comparison algorithm then calculates the percent sequence identity for the test sequence(s) relative to the reference sequence, based on the designated program parameters.

When comparing polynucleotide and polypeptide sequences, two sequences are said to be "identical" if the sequence of nucleotides or amino acids in the two sequences is the same when aligned for maximum correspondence, as described below. Comparisons between two sequences are typically performed by comparing the sequences over a comparison window to identify and compare local regions of sequence similarity. A "comparison window" as used herein, refers to a segment of at least 20 contiguous positions, usually 30 to 75, 40 to 50, or the full length of a sequence, in which a sequence may be compared to a reference sequence of the same number of contiguous positions after the two sequences are optimally aligned.

Optimal alignment of sequences for comparison may be conducted by the local identity algorithm of Smith and Waterman (1981) Add. APL. Math 2:482, by the identity alignment algorithm of Needleman and Wunsch (1970) J. Mol. Biol. 48:443, by the search for similarity methods of Pearson and Lipman (1988) Proc. Natl. Acad. Sci. USA 85: 2444, by computerized implementations of these algorithms (e.g., GAP, BESTFIT, BLAST, FASTA, and TFASTA in the Wisconsin Genetics Software Package, Genetics Computer Group (GCG), 575 Science Dr., Madison, WI), or by inspection.

One example of algorithms that are suitable for determining percent sequence identity are the Basic Local Alignment Search Tool (BLAST), BLAST 2.0 and PSI-BLAST algorithms, which are described in Altschul, et al., *J. Mol. Biol.* (1990) 215: 403-410, Altschul, et al., *Nucleic Acids Res.* (1977) 25: 3389-3402, and Altschul, et al., *Nucleic Acids Res.* (1997) 25(17):3389-402, respectively. Software for performing BLAST analyses is publicly available through the National Center for Biotechnology Information (blast.ncbi.nlm.nih.gov/Blast.cgi).

In one illustrative example, cumulative scores can be calculated using, for nucleotide sequences, the parameters M (reward score for a pair of matching residues; always >0) and N (penalty score for mismatching residues; always <0). Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a word length (W) of 11, and expectation (E) of 10, and the BLOSUM62 scoring matrix (see Henikoff and Henikoff (1989) Proc. Natl. Acad. Sci. USA 89: 10915) alignments, (B) of 50, expectation (E) of 10, M=5, N=−4 and a comparison of both strands.

For amino acid sequences, a scoring matrix can be used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLASTP algorithm parameters W, T and X determine the sensitivity and speed of the alignment.

In one approach, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residues occur in both sequences to yield the number of matched positions, dividing the number of matched positions by the total number of positions in the reference sequence (i.e., the window size) and multiplying the results by 100 to yield the percentage of sequence identity.

Residue positions which are not identical can differ by conservative amino acid substitutions. Conservative amino acid substitutions refer to the interchangeability of residues having similar side chains. For example, a group of amino acids having aliphatic side chains is glycine (Gly, G), alanine (Ala, A), valine (Val, V), leucine (Leu, L), and isoleucine (Ile, I); a group of amino acids having aliphatic-hydroxyl side chains is serine (Ser, S) and threonine (Thr, T); a group of amino acids having amide-containing side chains is asparagine (Asn, N) and glutamine (Gln, Q); a group of amino acids having aromatic side chains is phenylalanine (Phe, F), tyrosine (Tyr, Y), and tryptophan (Trp, W); a group of amino acids having basic side chains is lysine (Lys, K), arginine (Arg, R), and histidine (His, H); and a group of amino acids having sulfur-containing side chains is cysteine (Cys, C) and methionine (Met, M). Further, glutamic acid (Glu, E) and aspartic acid (Asp, D) are conservative amino acid substitutions.

In various embodiments, one or both of the first antigen binding domain and the second antigen binding domain independently comprise a Fab, an F(ab)2, Fv, a scFv, a sc(Fv)2, or a diabody. In some embodiments, the first antigen binding domain comprises a scFv and the second antigen binding domain comprises a Fab. In some embodiments, the first antigen binding domain comprises a Fab and the second antigen binding domain comprises a scFv. In some embodiments, the first antigen binding domain comprises a Fab and the second antigen binding domain comprises a Fab. In some embodiments, the first antigen binding domain comprises a scFv and the second antigen binding domain comprises a scFv. In some embodiments, the first antigen binding domain comprises a Fab and the second antigen binding domain comprises one or more extracellular domains of CD4, e.g., as set forth herein. In some embodiments, the first antigen binding domain comprises a scFv and the second antigen binding domain comprises one or more extracellular domains of CD4, e.g., as set forth herein. Embodiments comprising an scFv can have one or both of the following amino acid substitutions (numbering according to Kabat): (i) a cysteine (C) at position 44 in the scFv variable heavy domain; and (ii) a cysteine (C) at position 100 in the scFv variable light domain.

In some embodiments, the first antigen binding domain is a scFv comprising a VH and a VL, the scFv comprises an amino acid sequence selected from SEQ ID NOs: 59-66, or that is at least 80%, at least 85%, at least 90%, at least 91%, at least 92%, at least 93%, at least 94%, at least 95%, at least 96%, at least 97%, at least 98%, or at least 99% identical to an amino acid sequence selected from SEQ ID NOs: 59-66. In some embodiments, the first antigen binding domain is a scFv comprising a VH and a VL, the scFv comprises an amino acid sequence selected from SEQ ID NOs: 59-63, or that is at least 80%, at least 85%, at least 90%, at least 91%, at least 92%, at least 93%, at least 94%, at least 95%, at least 96%, at least 97%, at least 98%, or at least 99% identical to an amino acid sequence selected from SEQ ID NOs: 59-63. In some embodiments, the first antigen binding domain is a scFv comprising a VH and a VL, the scFv comprising an amino acid sequence selected from SEQ ID NOs: 59-66, e.g., SEQ ID NOs: 59-63, e.g., SEQ ID NOs: 61, 62 or 63, e.g., SEQ ID NOs: 62 or 63. Illustrative sequences of scFv of the first antigen binding domains of the multi-specific antigen binding molecules, targeting human CD3, are provided in Table C.

TABLE C

| SEQ ID NO: Ab name | scFv for anti-CD3 binding arm |
|---|---|
| 59 | EVQLVESGGGLVQPGGSLRLSCAASGFTFNTYAMNWVRQAP GKGLEWVGRIRSKYNNYATYYAX$_1$SVKX$_2$RFTISRDDSKNSL YLX$_8$MNSLX$_9$TEDTAX$_{10}$YYCVRHGNFGX$_3$SYVSWFAYWGQGT LVTVSSGGGGSGGGGSGGGGSGGGGSQAVVTQEPSLTVSPG GTVTLTCGSSTGAVTTGHYANWVQQKPGQAPRGLIGGTX$_4$X$_5$ RAPX$_7$VPARFSGSLLGGKAALTX$_{11}$SGAQPEDEAEYYCALWY SNX$_6$WVFGGGTKLTVL<br>X$_1$ is A or D;<br>X$_2$ is G or S;<br>X$_3$ is H or N;<br>X$_8$ is E or Q;<br>X$_9$ is K or R;<br>X$_{10}$ is M or V;<br>X$_4$X$_5$ is SN or NK;<br>X$_6$ is L or R;<br>X$_7$ is G or W; and<br>X$_{11}$ is I or L |
| 60 | EVQLVESGGGLVQPGGSLRLSCAASGFTFNTYAMNWVRQ APGKGLEWVGRIRSKYNNYATYYADSVKX$_2$RFTISRDDS KNSLYLX$_8$ANSLRTEDTAVYYCVRHGNFGHSYVSWFAYW GQGTLVTVSSGGGGSGGGGSGGGGSGGGGSQAVVTQEPS LIVSPGGTVTLICGSSIGAVTIGHYANWVQQKPGQAPRG LIGGTX$_4$X$_5$RAPGVPARFSGSLLGGKAALTISGAQPEDE AEYYCALWYSNRWVFGGGTKLTVL<br>X$_2$ is G or S;<br>X$_4$X$_5$ is SN or NK; and<br>X$_8$ is E or Q |
| 61 | EVQLVESGGGLVQPGGSLRLSCAASGFTFNTYAMNWVRQ APGKGLEWVGRIRSKYNNYATYYADSVKX$_2$RFTISRDDS KNSLYLX$_8$ANSLRTEDTAVYYCVRHGNFGHSYVSWFAYW GQGTLVTVSSGGGGSGGGGSGGGGSGGGGSQAVVTQEPS LTVSPGGTVTLICGSSTGAVTTGHYANWVQQKPGQAPRG LIGGTSNRAPGVPARFSGSLLGGKAALTISGAQPEDEAE YYCALWYSNRWVFGGGTKLTVL<br>X$_2$ is G or S; and<br>X$_8$ is E or Q |
| 62<br>3.13 | EVQLVESGGGLVQPGGSLRLSCAASGFTFNTYAMNWVRQ APGKGLEWVGRIRSKYNNYATYYADSVKGRFTISRDDSK NSLYLQMNSLRTEDTAVYYCVRHGNFGHSYVSWFAYWGQ GTLVTVSSGGGGSGGGGSGGGGSGGGGSQAVVTQEPSLT VSPGGTVTLICGSSTGAVTTGHYANWVQQKPGQAPRGLI GGTSNRAPGVPARFSGSLLGGKAALTISGAQPEDEAEYY CALWYSNRWVFGGGTKLTVL |
| 63<br>39.13 | EVQLVESGGGLVQPGGSLRLSCAASGFTFNTYAMNWVRQ APGKGLEWVGRIRSKYNNYATYYADSVKRFTISRDDSK NSLYLEMNSLRTEDTAVYYCVRHGNFGHSYVSWFAYWGQ GTLVTVSSGGGGSGGGGSGGGGSGGGGSQAVVTQEPSLT VSPGGTVTLICGSSTGAVTTGHYANWVQQKPGQAPRGLI GGTSNRAPGVPARFSGSLLGGKAALTISGAQPEDEAEYY CALWYSNRWVFGGGTKLTVL |
| 64<br>34.3 | EVQLVESGGGLVQPGGSLRLSCAASGFTFNTYAMNWVRQ APGKGLEWVGRIRSKYNNYATYYAASVKGRFTISRDDSK NSLYLQMNSLKTEDTAMYYCVRHGNFGHSYVSWFAYWGQ GTLVTVSSGGGGSGGGGSGGGGSGGGGSQAVVTQEPSLT VSPGGTVTLICGSSTGAVTTGHYANWVQQKPGQAPRGLI GGTNKRAPWTPARFSGSLLGGKAALTLSGAQPEDEAEYY CALWYSNLWVFGGGTKLTVL |
| 65<br>1.3 | EVQLVESGGGLVQPGGSLRLSCAASGFTFNTYAMNWVRQ APGKGLEWVGRIRSKYNNYATYYAASVKGRFTISRDDSK NSLYLQMNSLKTEDTAMYYCVRHGNFGNSYVSWFAYWGQ GTLVTVSSGGGGSGGGGSGGGGSGGGGSQAVVTQEPSLT VSPGGTVTLTCGSSTGAVTTGHYANWVQQKPGQAPRGLI GGTNKRAPWTPARFSGSLLGGKAALTLSGAQPEDEAEYY CALWYSNLWVFGGGTKLTVL |

TABLE C-continued

| SEQ ID NO: Ab name | scFv for anti-CD3 binding arm |
|---|---|
| 66 3.8 | EVQLVESGGGLVQPGGSLRLSCAASGFTFNTYAMNWVRQ APGKGLEWVGRIRSKYNNYATYYADSVKGRFTISRDDSK NSLYLQMNSLRTEDTAVYYCVRHGNFGHSYVSWFAYWGQ GTLVTVSSGGGGSGGGGSGGGGSGGGGSQAVVTQEPSLT VSPGGTVTLTCGSSTGAVTTGHYANWVQQKPGQAPRGLI GGTNKRAPGVPARFSGSLLGGKAALTISGAQPEDEAEYY CALWYSNRWVFGGGTKLTVL |

In some embodiments, the first antigen binding domain, e.g., in scFv or Fab format, binds to CD3 with a $K_D$ of lower than 10 nM, e.g., lower than 9.5 nM, 9.0 nM, 8.5 nM, 8.0 nM, 7.5 nM, 7.0 nM, 6.5 nM, 6.0 nM, 5.5 nM, 5.0 nM, 4.5 nM, 4.0 nM, 3.5 nM, 3.0 nM, or lower. In some embodiments, the first antigen binding domain binds to CD3 with a $K_D$ of lower than 10 nM, e.g., lower than 5.0 nM, 4.5 nM, 4.0 nM, 3.5 nM, 3.0 nM, or lower. Protein binding affinity can be determined by any method known in the art, e.g., by surface plasmon resonance (SPR), e.g., using Octet as described herein.

3. Anti-HIV Antigen Arm

HIV-1 is the main family of HIV and accounts for 95% of all infections worldwide. HIV-2 is mainly seen in a few West African countries.

HIV viruses are divided into specific groups, M, N, O and P, of which M is the "major" group and responsible for majority of HIV/AIDS globally. Based on their genetic sequence, Group M is further subdivided into subtypes (also called clades) with prevalence in distinct geographical locations.

A Group M "subtype" or "clade" is a subtype of HIV-1 group M defined by genetic sequence data. Examples of Group M subtypes include Subtypes A-K. Some of the subtypes are known to be more virulent or are resistant to different medications. There are also "circulating recombinant forms" or CRFs derived from recombination between viruses of different subtypes, which are each given a number. CRF12_BF, for example, is a recombination between subtypes B and F. Subtype A is common in West Africa. Subtype B is the dominant form in Europe, the Americas, Japan, Thailand, and Australia. Subtype C is the dominant form in Southern Africa, Eastern Africa, India, Nepal, and parts of China. Subtype D is generally only seen in Eastern and central Africa. Subtype E has never been identified as a nonrecombinant, only recombined with subtype A as CRF01_AE. Subtype F has been found in central Africa, South America and Eastern Europe. Subtype G (and the CRF02_AG) have been found in Africa and central Europe. Subtype H is limited to central Africa. Subtype I was originally used to describe a strain that is now accounted for as CRF04_cpx, with the cpx for a "complex" recombination of several subtypes. Subtype J is primarily found in North, Central and West Africa, and the Caribbean Subtype K is limited to the Democratic Republic of Congo and Cameroon. These subtypes are sometimes further split into subsubtypes such as A1 and A2 or F1 and F2. In 2015, the strain CRF19, a recombinant of subtype A, subtype D, and subtype G, with a subtype D protease was found to be strongly associated with rapid progression to AIDS in Cuba.

This disclosure provides, inter alia, multi-specific antigen binding molecules comprising second antigen binding domains derived from human anti-HIV neutralizing antibodies (e.g., broadly neutralizing Abs) that target the gp120 polypeptide on the surface of HIV-infected cells. Neutralizing antibodies against viral envelope proteins provide adaptive immune defense against HIV-1 exposure by blocking the infection of susceptible cells. Broad neutralization indicates that the antibodies can neutralize HIV-1 isolates from different clades. Thus, the multi-specific antigen binding molecules described herein have cross-clade binding activity.

gp120

Envelope glycoprotein gp120 (or gp120) is a 120 kDa glycoprotein that is part of the outer layer of HIV. It presents itself as viral membrane spikes consisting of three molecules of gp120 linked together and anchored to the membrane by gp41 protein. Gp120 is essential for viral infection as it facilitates HIV entry into the host cell through its interaction with cell surface receptors. These receptors include DC-SIGN, Heparan Sulfate Proteoglycan, and the CD4 receptor. Binding to CD4 on helper T-cells induces the start of a cascade of conformational changes in gp120 and gp41 that lead to the fusion of the virus with the host cell membrane.

Gp120 is encoded by the HIV env gene. The env gene encodes a gene product of around 850 amino acids. The primary env product is the protein gp160, which gets cleaved to gp120 (about 480 amino acids) and gp41 (about 345 amino acids) in the endoplasmic reticulum by the cellular protease furin.

The amino acid sequence of an exemplary gp160 polypeptide of HIV clone WITO is provided below (the V3 hypervariable loop is boldened and the N332 potential N-linked glycosylation site is boldened and underlined):

(SEQ ID NO: 67)
MKVMGTKKNYQHLWRWGIMLLGMLMMSSAAEQLWVTVYYGVPVWREANTT

LFCASDAKAYDTEVHNVWATHACVPTDPNPQEVVMGNVTEDFNMWKNNMV

EQMHEDIISLWDQSLKPCVKLTPLCVTLHCTNVTISSTNGSTANVTMREE

MKNCSFNTTTVIRDKIQKEYALFYKLDIVPIEGKNTNTSYRLINCNTSVI

TQACPKVSFEPIPIHYCAPAGFAILKCNNKTFNGKGPCRNVSTVQCTHGI

KPVVSTQLLLNGSLAEEDIIIRSENFTNNGKNIIVQLKEPVKINCTRPGN

NTRRSINIGPGRAFYATGAIIGDIRKAHCN̲ISTEQWNNTLTQIVDKLREQ

FGNKTIIFNQSSGGDPEVVMHTFNCGGEFFYCNSTQLFNSTWFNNGTSTW

NSTADNITLPCRIKQVINMWQEVGKAMYAPPIRGQIDCSSNITGLILTRD

GGSNSSQNETFRPGGGNMKDNWRSELYKYKVVKIEPLGIAPTRAKRRVVQ

REKRAVTLGAVFLGFLGAAGSTMGAASLTLTVQARLLLSGIVQQQSNLLR

AIEAQQHMLQLTVWGIKQLQARVLAIERYLKDQQLLGIWGCSGKLICTTT

VPWNTSWSNKSYDYIWNNMTWMQWEREIDNYTGFIYTLIEESQNQQEKNE

LELLELDKWASLWNWFNITNWLWYIKLFIMIIGGLVGLRIVCAVLSIVNR

VRQGYSPLSFQTRLPNPRGPDRPEETEGEGGERDRDRSARLVNGFLAIIW

DDLRSLCLFSYHRLRDLLLIVARVVEILGRRGWEILKYWWNLLKYWSQEL

KNSAVSLLNVTAIAVAEGTDRVIEIVQRAVRAILHIPTRIRQGFERALL

The amino acid sequence of an exemplary gp160 polypeptide of HIV clone identified in NCBI Ref Seq No. NP_057856.1 is provided below (the V3 hypervariable loop is boldened and the N332 potential N-linked glycosylation site is boldened and underlined):

(SEQ ID NO: 68)
MRVKEKYQHLWRWGWRWGTMLLGMLMICSATEKLWVTVYYGVPVWKEATT

TLFCASDAKAYDTEVHNVWATHACVPTDPNPQEVVLVNVTENFNMWKNDM

VEQMHEDIISLWDQSLKPCVKLTPLCVSLKCTDLKNDTNTNSSSGRMIME

KGEIKNCSFNISTSIRGKVQKEYAFFYKLDIIPIDNDTTSYKLTSCNTSV

ITQACPKVSFEPIPIHYCAPAGFAILKCNNKTFNGTGPCTNVSTVQCTHG

IRPVVSTQLLLNGSLAEEEVVIRSVNFTDNAKTIIVQLNTSVEINCTRPN

NNTRKRIRIQRGPGRAFVTIGKIGNMRQAHCNISRAKWNNTLKQIASKLR

EQFGNNKTIIFKQSSGGDPEIVTHSFNCGGEFFYCNSTQLFNSTWFNSTW

STEGSNNTEGSDTITLPCRIKQIINMWQKVGKAMYAPPISGQIRCSSNIT

GLLLTRDGGNSNNESEIFRPGGGDMRDNWRSELYKYKVVKIEPLGVAPTK

AKRRVVQREKRAVGIGALFLGFLGAAGSTMGAASMTLTVQARQLLSGIVQ

QQNNLLRAIEAQQHLLQLTVWGIKQLQARILAVERYLKDQQLLGIWGCSG

KLICTTAVPWNASWSNKSLEQIWNHTTWMEWDREINNYTSLIHSLIEESQ

NQQEKNEQELLELDKWASLWNWFNITNWLWYIKLFIMIVGGLVGLRIVFA

VLSIVNRVRQGYSPLSFQTHLPTPRGPDRPEGIEEEGGERDRDRSIRLVN

GSLALIWDDLRSLCLFSYHRLRDLLLIVTRIVELLGRRGWEALKYWWNLL

QYWSQELKNSAVSLLNATAIAVAEGTDRVIEVVQGACRAIRHIPRRIRQG

LERILL

The amino acid sequence of an exemplary gp120 polypeptide of HXB2 subtype B HIV-1 isolate (GenBank Accession No. K0345; corresponding to residues 1-511 of NCBI Ref Seq No. NP_057856.1) is provided below (the V3 hypervariable loop is boldened and the N332 potential N-linked glycosylation site is boldened and underlined; signal peptide is underlined):

(SEQ ID NO: 69)
MRVKEKYQHLWRWGWRWGTMLLGMLMICSATEKLWVTVYYGVPVWKEATT

TLFCASDAKAYDTEVHNVWATHACVPTDPNPQEVVLVNVTENFNMWKNDM

VEQMHEDIISLWDQSLKPCVKLTPLCVSLKCTDLKNDTNTNSSSGRMIME

KGEIKNCSFNISTSIRGKVQKEYAFFYKLDIIPIDNDTTSYKLTSCNTSV

ITQACPKVSFEPIPIHYCAPAGFAILKCNNKTFNGTGPCTNVSTVQCTHG

IRPVVSTQLLLNGSLAEEEVVIRSVNFTDNAKTIIVQLNTSVEINCTRPN

NNTRKRIRIQRGPGRAFVTIGKIGNMRQAHCNISRAKWNNTLKQIASKLR

EQFGNNKTIIFKQSSGGDPEIVTHSFNCGGEFFYCNSTQLFNSTWFNSTW

STEGSNNTEGSDTITLPCRIKQIINMWQKVGKAMYAPPISGQIRCSSNIT

GLLLTRDGGNSNNESEIFRPGGGDMRDNWRSELYKYKVVKIEPLGVAPTK

AKRRVVQREKR

The amino acid sequence of an exemplary gp120 polypeptide is provided below:

(SEQ ID NO: 70)
AEQLWVIVYYGVPVWREANTTLFCASDAKAYDTEVHNVWATHACVPTDPN

PQEVVMGNVTEDFNMWKNNMVEQMHEDIISLWDQSLKPCVKLTPLCVTLH

CTNVTISSTNGSTANVTMREEMKNCSFNTTTVIRDKIQKEYALFYKLDIV

PIEGKNTNTSYRLINCNTSVITQACPKVSFEPIPIHYCAPAGFAILKCNN

KTFNGKGPCRNVSTVQCTHGIKPVVSTQLLLNGSLAEEDIIIRSENFTNN

GKNIIVQLKEPVKINCTRPGNNTRRSINIGPGRAFYATGAIIGDIRKAHC

NISTEQWNNTLTQIVDKLREQFGNKTIIFNQSSGGDPEVVMHTFNCGGEF

FYCNSTQLFNSTWFNNGTSTWNSTADNITLPCRIKQVINMWQEVGKAMYA

PPIRGQIDCSSNITGLILTRDGGSNSSQNETFRPGGGNMKDNWRSELYKY

KVVKIEPLGIAPTRAKRRVVQREKR.

The amino acid sequence of another exemplary gp120 polypeptide (see, bioafrica.net/proteomics/ENV-GP120prot.html) is provided below:

(SEQ ID NO: 71)
TEKLWVTVYY GVPVWKEATT TLFCASDAKA YDTEVHNVWA

THACVPTDPN PQEVVLVNVT ENFNMWKNDM VEQMHEDIIS

LWDQSLKPCV KLTPLCVSLK CTDLKNDTNT NSSSGRMIME

KGEIKNCSFN ISTSIRGKVQ KEYAFFYKLD IIPIDNDTTS

YKLTSCNTSV ITQACPKVSF EPIPIHYCAP AGFAILKCNN

KTFNGTGPCT NVSTVQCTHG IRPVVSTQLL LNGSLAEEEV

VIRSVNFTDN AKTIIVQLNT SVEINCTRPN NNTRKRIRIQ

RGPGRAFVTI GKIGNMRQAH CNISRAKWNN TLKQIASKLR

EQFGNNKTII FKQSSGGDPE IVTHSFNCGG EFFYCNSTQL

FNSTWFNSTW STEGSNNTEG SDTITLPCRI KQIINMWQKV

GKAMYAPPIS GQIRCSSNIT GLLLTRDGGN SNNESEIFRP

GGGDMRDNWR SELYKYKVVK IEPLGVAPTK AKRRVVQREK R

Genomic diversity among independent human immunodeficiency virus type 1 (HIV-1) isolates, to a lesser degree among sequential isolates from the same patients, and even within a single patient isolate is a well-known feature of HIV-1. Although this sequence heterogeneity is distributed throughout the genome, most of the heterogeneity is located in the env gene. Comparison of predicted amino acid sequences from several different isolates has shown that sequence heterogeneity is clustered in five variable regions (designated V1 through V5) of the surface glycoprotein, gp120. The V3 region, although only 35 amino acids long, exhibits considerable sequence variability. Interestingly, in spite of this variability, the V3 region includes determinants that mediate interactions with $CD4^+$ cells. The increase in gp120 variability results in higher levels of viral replication, suggesting an increase in viral fitness in individuals infected by diverse HIV-1 variants. Variability in potential N-linked glycosylation sites (PNGSs) also result in increased viral fitness. PNGSs allow for the binding of long-chain carbohydrates to the high variable regions of gp120. Thus, the number of PNGSs in env might affect the fitness of the virus by providing more or less sensitivity to neutralizing antibodies.

A consensus sequence of the V3 region of gp120 (Milich et al., *J Virol.*, (1993) 67(9):5623-5634) is provided below:

(SEQ ID NO: 72)
CTRPNNNTRKSIHIGPGRAFYTTGEIIGDIRQAHC.

Anti-gp120 and Anti-gp41 Antigen Binding Domains

This disclosure features anti-gp120 or anti-gp41 multi-specific antigen binding molecules comprising a second antigen binding domain that targets and binds to gp120 or gp41, respectively. In certain embodiments, these multi-specific antigen binding molecules bind to HIV-1 antigens expressed on a cell surface and eliminate or kill the infected cell.

In certain embodiments, the second antigen binding domains in the herein described multi-specific antigen binding molecules are derived from human neutralizing antibodies (e.g., monoclonal) that target HIV-1. A "neutralizing antibody" is one that can neutralize the ability of HIV to at least one of initiate and perpetuate an infection in at least one of a host in vivo and in target cells in vitro. The disclosure provides neutralizing monoclonal human antibodies, wherein the antibody recognizes an antigen from HIV, e.g., a gp120 polypeptide. In certain embodiments, a "neutralizing antibody" may inhibit the entry of HIV-1 virus, e.g., SF162 and/or JR-CSF, with a neutralization index>1.5 or >2.0 (Kostrikis L G et al., *J. Virol.*, 70(1): 445-458 (1996)).

In some embodiments, the second antigen binding domains in the herein described multi-specific antigen binding molecules are derived from human broadly neutralizing antibodies (e.g., monoclonal) that target HIV-1. By "broadly neutralizing antibodies" are meant antibodies that neutralize more than one HIV-1 virus species (from diverse clades and different strains within a clade) in a neutralization assay. A broad neutralizing antibody may neutralize at least 2, 3, 4, 5, 6, 7, 8, 9 or more different strains of HIV-1, the strains belonging to the same or different clades. In particular embodiments, a broad neutralizing antibody may neutralize multiple HIV-1 species belonging to at least 2, 3, 4, 5, or 6 different clades. In certain embodiments, the inhibitory concentration of the multi-specific antigen binding molecule may be less than 0.0001 µg/ml, less than 0.001 µg/ml, less than 0.01 µg/ml, less than 0.1 µg/ml, less than 0.5 µg/ml, less than 1.0 µg/ml, less than 5 µg/ml, less than 10 µg/ml, less than 25 µg/ml, less than 50 µg/ml, or less than 100 µg/ml to neutralize 50% of the input virus in the neutralization assay.

In some embodiments, the second antigen binding domain of the multi-specific antigen binding molecules binds to an epitope or region of gp120 selected from the group consisting of: (i) third variable loop (V3) (e.g., high mannose patch) comprising a N332 oligomannose glycan; (ii) second variable loop (V2) (e.g., Env trimer apex); (iii) CD4 binding site (CD4bs); (iv) gp120/gp41 interface; or (v) silent face of gp120. The foregoing epitopes or regions of gp120 bound by broadly neutralizing antibodies are described, e.g., in McCoy, *Retrovirology* (2018) 15:70; Sok and Burton, *Nat Immunol.* 2018 19(11):1179-1188; Possas, et al., *Expert Opin Ther Pat.* 2018 July; 28(7):551-560; and Stephenson and Barouch, *Curr HIV/AIDS Rep* (2016) 13:31-37, which are hereby incorporated herein by reference in their entirety for all purposes.

In some embodiments, the second antigen binding domain binds to an epitope or region of gp120 in the third variable loop (V3) (e.g., high mannose patch) comprising a N332 oligomannose glycan and competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. Additional broadly neutralizing antibodies that bind to gp120 in the third variable loop (V3) (e.g., high mannose patch) comprising a N332 oligomannose glycan and which can be used in the second antigen binding domain of the herein described multi-specific antigen binding molecules are described, e.g., in WO 2012/030904; WO 2014/063059; WO 2016/149698; WO 2017/106346; WO 2018/075564, WO 2018/125813; WO 2018/237148, WO 2019/226829, WO 2020/023827, WO2020/056145 and Kerwin, et al., *J Pharm Sci.* 2020 January; 109(1):233-246, which are hereby incorporated herein by reference in their entireties for all purposes.

In some embodiments, the second antigen binding domain binds to an epitope or region of gp120 in the second variable loop (V2) (e.g., Env trimer apex) and competes with or comprises VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. Additional broadly neutralizing antibodies that bind to gp120 in the second variable loop (V2) (e.g., Env trimer apex) and which can be used in the second antigen binding domain of the herein described multi-specific antigen binding molecules are described, e.g., in WO 2010/107939; WO 2012/030904; WO 2018/075564 and WO 2018/125813, which are hereby incorporated herein by reference in their entireties for all purposes.

gp120 CD4 Binding Site

Antibody variants described herein bind to the CD4 binding site (CD4bs) of HIV gp120. The CD4 binding site (CD4bs) involves structurally conserved sites located within the $\beta1$-$\alpha1$, loop D, $\beta20$-$\beta21$ (bridging sheet) and $\beta24$-$\alpha5$ of gp120, which determine the CD4 binding and are involved in the epitopes of CD4bs-directed antibodies (Qiao, et al., *Antiviral Res.* 2016 August; 132:252-61). The CD4bs of gp120 forms conformational epitopes recognized by anti-CD4bs antibodies involving one or more amino acid residues selected from Thr278, Asp279, Ala281, Thr283, Asp368, Trp427, Glu460, Ser461, Glu462, Leu452, Leu453 and Arg476. The amino acid residues and position numbering is with reference to HXB2 subtype B HIV-1 isolate, which corresponds to residues 1-511 of NCBI Ref Seq No. NP_057856.1, provided below. Residues Thr278, Asp279, Asn280, Ala281, Thr283, Asp368, Trp427, Leu452, Leu453, Gly459, Glu464, Ser465, Glu466, Ile467, Gly472, Gly473 and Arg476, which can contribute to the gp120 CD4bs, are boldened and underlined:

(SEQ ID NO: 73)
MRVKEKYQHLWRWGWRWGTMLLGMLMICSATEKLWVTVYYGVPVWKEATT

TLFCASDAKAYDTEVHNVWATHACVPTDPNPQEVVLVNVTENFNMWKNDM

VEQMHEDIISLWDQSLKPCVKLTPLCVSLKCTDLKNDTNTNSSSGRMIME

-continued

```
KGEIKNCSFNISTSIRGKVQKEYAFFYKLDIIPIDNDTTSYKLTSCNTSV

ITQACPKVSFEPIPIHYCAPAGFAILKCNNKTFNGTGPCTNVSTVQCTHG

IRPVVSTQLLLNGSLAEEEVVIRSVNFTDNAKTIIVQLNTSVEINCTRPN

NNTRKRIRIQRGPGRAFVTIGKIGNMRQAHCNISRAKWNNTLKQIASKLR

EQFGNNKTIIFKQSSGGDPEIVTHSFNCGGEFFYCNSTQLFNSTWFNSTW

STEGSNNTEGSDTITLPCRIKQIINMWQKVGKAMYAPPISGQIRCSSNIT

GLLLTRDGGNSNNESEIFRPGGGDMRDNWRSELYKYKVVKIEPLGVAPTK

AKRRVVQREKR.
```

Tridimensional models depicting amino acid residues contributing to the gp120 CD4bs are provided, e.g., in Canducci, et al., *Retrovirology.* 2009 Jan. 15; 6:4; Falkowska, et al., *J Virol.* 2012 April; 86(8):4394-403; Li, et al., *J. Virol.* 2012 October; 86(20):11231-41; Gristick, et al., *Nat Struct Mol Biol.* 2016 October; 23(10):906-915; Kwon, et al., *Nat Struct Mol Biol.* 2015 July; 22(7):522-31; Liu, et al., *Nat Struct Mol Biol.* 2017 April; 24(4):370-378; Chen, et al., *Science.* 2009 Nov. 20; 326(5956):1123-7 and Lyumkis, et al., *Science.* 2013 Dec. 20; 342(6165):1484-90. In some embodiments, the second antigen binding domain binds to an epitope or region of gp120 in the CD4 binding site (CD4bs) and competes with or comprises VH and VL regions from an antibody selected from the group consisting of 3BNC117, GS-9723, GS-5423, 3BNC60, b12, CH103, 1NC9, 12A12, VRC01, VRC07, VRC07-523, N6, NIH45-46 and PGV04 (a.k.a., VRC-PG04) for binding to gp120 CD4bs. In some embodiments, the antibody variants described herein bind to an overlapping or identical epitope to the epitope bound by one or more of anti-CD4bs antibodies 3BNC117, GS-9723, GS-5423, 3BNC60, b12, CH103, 1NC9, 12A12, VRC01, VRC07, VRC07-523, N6, NIH45-46 and PGV04 (a.k.a., VRC-PG04).

In some embodiments, the second antigen binding domain binds to an epitope or region of gp120 in the CD4 binding site (CD4bs) and comprises immunoglobulin VH and VL (e.g., in Fab or scFv format) that compete with or comprise VH and VL regions from an antibody selected from the group consisting of b12, F105, VRC01, VRC07, VRC07-523, VRC03, VRC06, VRC06b01 VRC08, VRC0801, NIH45-46, 3BNC117, GS-9723, GS-5423, 3BNC60, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. Additional broadly neutralizing antibodies that bind to gp120 in the CD4 binding site (CD4bs) and which can be used in the second antigen binding domain of the herein described multi-specific antigen binding molecules are described, e.g., in WO 2011/038290; WO 2012/158948; WO 2013/016468; WO 2013/192589; WO 2013/086533; WO 2015/128846; WO 2016/149698; WO 2016/149695; WO 2018/075564; WO 2018/125813; WO 2018/237357; WO 2020/010107, WO 2020/086446 and U.S. Pat. Nos. 9,493,549 and 9,879,068, which are hereby incorporated herein by reference in their entireties for all purposes.

In some embodiments, the second antigen binding domain binds to an epitope or region of gp120 in the CD4 binding site (CD4bs) and competes with or comprises VH and VL regions from 3BNC117 and comprises Phe-Asp-Phe-Asp (FDFD) (SEQ ID NO: 1040) at positions 74a, 74b, 74c, and 74d of the VH (position numbering according to Kabat). In some embodiments, the second antigen binding domain binds to an epitope or region of gp120 in the CD4 binding site (CD4bs) and competes with or comprises VH and VL regions from 3BNC117 and comprises a framework region 3 (FR3) of the VH comprising the following amino acid sequence RVSLTRHASFDFDTFSFYMDLKALRSDD-TAVYFCAR (SEQ ID NO: 74). Crystallographic studies have shown that framework region 3 at VH Kabat position numbers 74a, 74b, 74c and 74d form part of the paratope of 3BNC117 variants, directly contacting the antigen target, gp120. See, e.g., Lee, et al., *Immunity* (2017) 46(4): 690-702 (FIG. 1G, identifying residue W71d); Klein, et al., *Cell.* (2013) 153(1):126-38 (FIGS. 4 and 5); and Zhou, et al., (2013) *Immunity* (2013) 39 245-258 (Table 1); ribbon diagrams of crystallized structures of 5V8L, 5V8M, 4JPV and 4LSV can be viewed at rcsb.org. In some embodiments, at least 50%, at least 60%, at least 70%, least 80%, at least 85%, at least 90%, or more, N-linked glycosylation sites in at least one of the first VH, the first VL, the second VH and the second VL are sialylated. In some embodiments, the N-linked glycosylation sites in at least one of the first VH, the first VL, the second VH and the second VL have a sialic acid occupancy (e.g., a glycan comprising one or two terminal sialic acid residues) of at least 40%, at least 50%, at least 60%, at least 70%, least 80%, at least 85%, at least 90%, or more. In some embodiments, the N-linked glycosylation site at VL asparagine amino acid position 72 (N72) according to Kabat numbering is sialylated. In some embodiments, the sialylated N-linked glycosylation sites in at least one of the first VH, the first VL, the second VH and the second VL comprise from 1 to 5 sialic acid residues, e.g., from 1 to 4 sialic acid residues, e.g., from 1 to 3 sialic acid residues, e.g., from 1 to 2 sialic acid residues. In some embodiments, at least one of the first VH, the first VL, the second VH and the second VL are sialylated with N-acetylneuraminic acid (NANA). In some embodiments, the sialic acid residues are present in biantennary structures. In some embodiments, the sialic acid residues are present in complex N-linked glycan structures. In some embodiments, the sialic acid residues are present in hybrid N-linked glycan structures.

In some embodiments, the second antigen binding domain binds to an epitope or region of gp120 in the CD4 binding site (CD4bs) and comprises an EC domain of CD4 (e.g., domain 1 (D1), D1-D1 (tandem), D1-D2, D1-D2-D3-D3, or D1-D2-D3-D4). Illustrative CD4 extracellular domains that can be used in the herein described multi-specific antigen binding molecules are described, e.g., in WO2011146891, WO2014150748 and WO2016153572. In some embodiments, the one or more EC domains of CD4 comprises an amino acid sequence that is at least 80%, at least 85%, at least 90%, at least 91%, at least 92%, at least 93%, at least 94%, at least 95%, at least 96%, at least 97%, at least 98%, at least 99% identical, or 100% identical, to a CD4 EC domain selected from:

(i)
```
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVG
```

(SEQ ID NO: 746; see, e.g., Chen, et al., *J Virol.* 2014 January; 88(2):1125-39);

-continued (ii)
(SEQ ID NO: 747)
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVGG

GGSGKKVVYGKKGDTVELTCTASQKKNIQFHWKNSNQIKILGNQGSFLTK

GPSKLNDRVDSRRSLWDQGNFPLIIKNLKPEDSDTYICEVEDQKEEVQLV

VVG;

(iii)
(SEQ ID NO: 748)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFG;
or (iv)
(SEQ ID NO: 749)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFGG

GGSGKKVVLGKKGDTVELTCTASQKKSIQFHWKNSNQIKILGNQGSFLTK

GPSKLNDRADSRRSLWDQGNFPLIIKNLKIEDSDTYICEVEDQKEEVQLL

VFG.

In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, provided is a multi-specific antigen binding molecule comprising a first antigen binding domain that binds to human CD3 and a second antigen binding domain that binds to HIV gp120, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746.

In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO: 746.

In some embodiments, provided is a multi-specific antigen binding molecule comprising a first antigen binding domain that binds to human CD3 and a second antigen binding domain that binds to HIV gp120, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746.

In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO: 746.

In some embodiments, provided is a multi-specific antigen binding molecule comprising a first antigen binding domain that binds to human CD3 and a second antigen binding domain that binds to HIV gp120, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746.

In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO: 746.

In some embodiments, provided is a multi-specific antigen binding molecule comprising a first antigen binding domain that binds to human CD3 and a second antigen binding domain that binds to HIV gp120, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746.

In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 96%, at least 97%, at least 98%, or at least 99%) identical to a CD4 EC domain of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO: 746.

In some embodiments, provided is a multi-specific antigen binding molecule comprising a first antigen binding domain that binds to human CD3 and a second antigen binding domain that binds to HIV gp120, wherein the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749, e.g., SEQ ID NO: 746.

In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 50 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 50 and 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 50 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 50 and 56; and the second antigen binding domain comprises one EC domain of CD4 comprising an amino acid sequence of SEQ ID NO: 746. In some embodiments, the first antigen binding domain comprises a first VH and a first VL comprising amino acid sequences that are at least 99% identical to the amino acid sequences set forth, respectively: SEQ ID NOs: 50 and 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH and a first VL comprising the amino acid sequences set forth, respectively: SEQ ID NOs: 50 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising amino acid sequences that are at least 99% identical to the amino acid sequences set forth, respectively: SEQ ID NOs: 50 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising the amino acid sequence of SEQ ID NO: 50 and a first VL comprising an amino acid sequence that is at least 95% identical to the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising the amino acid sequence of SEQ ID NO: 50 and a first VL comprising an amino acid sequence that is at least 95% identical to the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising the amino acid sequence of SEQ ID NO: 50 and a first VL comprising an amino acid sequence that is at least 99% identical to the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising the amino acid sequence of SEQ ID NO: 50 and a first VL comprising an amino acid sequence that is at least 99% identical to the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising an amino acid sequence that is at least 95% identical to the amino acid sequence of SEQ ID NO: 50 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising an amino acid sequence that is at least 95% identical to the amino acid sequence of SEQ ID NO: 50 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising an amino acid sequence that is at least 99% identical to the amino acid sequence of SEQ ID NO: 50 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising an amino acid sequence that is at least 99% identical to the amino acid sequence of SEQ ID NO: 50 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising the amino acid sequences set forth, respectively: SEQ ID NOs: 50 and 56; and the second antigen binding domain comprises one EC domain of CD4 comprising an amino acid sequence of SEQ ID NO: 746.

In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence of SEQ ID NO: 746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO: 746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO: 746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence of SEQ ID NO: 746.

In some embodiments, the second antigen binding domain binds to an epitope or region of gp120 in the gp120/gp41 interface and competes with or comprises VH and VL regions from an antibody selected from the group consisting of PGT-151, CAP248-2B, 35O22, 8ANC195, ACS202, VRC34 and VRC34.01. Additional broadly neutralizing antibodies that bind to gp120 in the gp120/gp41 interface and which can be used in the second antigen binding domain of the herein described multi-specific antigen binding molecules are described, e.g., in WO 2011/038290; WO 2012/030904 and WO2017/079479, which are hereby incorporated herein by reference in their entireties for all purposes.

In some embodiments, the second antigen binding domain binds to an epitope or region of the gp120 silent face and competes with or comprises VH and VL regions from an antibody selected from VRC-PG05 and SF12. See, e.g., Schoofs, et al., *Immunity*. (2019) 50(6):1513-1529.

In some embodiments, the second antigen binding domain binds to an epitope or region of gp41 in the membrane proximal region (MPER). Additional broadly neutralizing antibodies that bind to gp41 in the MPER and which can be used in the second antigen binding domain of the herein described multi-specific antigen binding molecules are described, e.g., in WO 2011/034582; WO 2011/038290; WO 2011/046623 and WO 2013/070776, which are hereby incorporated herein by reference in their entireties for all purposes.

In some embodiments, the second antigen binding domain binds to an epitope or region of gp41 in the membrane proximal region (MPER) and competes with or comprises VH and VL regions from an antibody selected from the group consisting of 10E8, 10E8v4, 10E8-5R-100cF, 4E10, DH511.11P, 2F5, 7b2, and LN01.

In some embodiments, the second antigen binding domain binds to an epitope or region of the gp41 fusion peptide and competes with or comprises VH and VL regions from an antibody selected from the group consisting of VRC34 and ACS202.

Additional broadly neutralizing antibodies which can be used in the second antigen binding domain of the herein described multi-specific antigen binding molecules are described, e.g., in U.S. Pat. Nos. 8,673,307; 9,493,549; 9,783,594; 10,239,935; and patent publications numbers US2018371086, US2020223907, WO 2012/154312; WO2012/158948; WO 2013/086533; WO 2013/142324; WO2014/063059; WO 2014/089152; WO 2015/048462; WO 2015/103549; WO 2015/117008; WO2016/014484; WO 2016/154003; WO 2016/196975; WO 2016/149710; WO2017/096221; WO 2017/133639; and WO 2017/133640, which are hereby incorporated herein by reference in their entireties for all purposes. Additional examples include those described in Sajadi, et al., Cell. (2018) 173 (7):1783-1795; Sajadi, et al., J Infect Dis. (2016) 213(1): 156-64; Klein et al., Nature, 492(7427): 118-22 (2012), Horwitz et al., Proc Natl Acad Sci USA, 110(41): 16538-43 (2013), Scheid, et al., Science, 333: 1633-1637 (2011), Scheid, et al., Nature, 458:636-640 (2009), Eroshkin et al, Nucleic Acids Res., 42 (Database issue):D1 133-9 (2014), Mascola et al., Immunol Rev., 254(1):225-44 (2013), such as 2F5, 4E10, M66.6, CAP206-CH12, 10E8, 10E8v4, 10E8-5R-100cF, DH511.11P, 7b2, and LN01 (all of which bind the MPER of gp41); PG9, PG16, CAP256, CAP256-VRC26, CAP256-VRC26.25, CH01-04 (all of which bind V1V2-glycan), 2G12 (which binds to outer domain glycan); b12, F105, VRC01, VRC07, VRC07-523, VRC03, VRC06, VRC06b01 VRC08, VRC0801, NIH45-46, 3BNC117, 3BNC60, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25 (all of which bind to the CD4 binding site), which are hereby incorporated herein by reference in their entireties for all purposes.

In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to Kabat) set forth, respectively, in: SEQ ID NOs: 76, 77, 78, 79, 80 and 81; SEQ ID NOs: 76, 82, 78, 79, 80 and 81; SEQ ID NOs: 83, 84, 85, 86, 80 and 87; SEQ ID NOs: 83, 88, 85, 86, 80 and 87; SEQ ID NOs: 90, 91, 92, 93, 94 and 95; SEQ ID NOs: 90, 91, 96, 93, 94 and 95; SEQ ID NOs: 97, 98, 99, 100, 101 and 102; SEQ ID NOs: 103, 104, 105, 106, 94 and 107; SEQ ID NOs: 108, 109, 110, 111, 112 and 113; SEQ ID NOs: 114, 115, 116, 117, 118 and 119; SEQ ID NOs: 114, 120, 121, 122, 118 and 123; SEQ ID NOs: 124, 125, 126, 127, 128 and 113; SEQ ID NOs: 129, 115, 131, 127, 118 and 113; SEQ ID NOs: 132, 133, 134, 135, 136 and 137; SEQ ID NOs: 138, 139, 140, 141, 142 and 143; SEQ ID NOs: 144, 145, 146, 147, 148 and 143; SEQ ID NOs: 149, 150, 151, 152, 153 and 143; SEQ ID NOs: 154, 155, 156, 157, 158 and 159; SEQ ID NOs: 160, 161, 162, 163, 164 and 165; SEQ ID NOs: 166, 161, 167, 163, 164 and 165; SEQ ID NOs: 168, 169, 170, 171, 172 and 173; SEQ ID NOs: 168, 174, 170, 171, 172 and 173; SEQ ID NOs: 175, 176, 177, 171, 172 and 173; SEQ ID NOs: 178, 179, 180, 181, 182 and 183; SEQ ID NOs: 184, 185, 186, 187, 188 and 189; SEQ ID NOs: 190, 191, 192, 193, 194 and 195; SEQ ID NOs: 196, 197, 198, 199, 200 and 201; SEQ ID NOs: 202, 203, 204, 205, 206 and 207; SEQ ID NOs: 208, 209, 210, 211, 212 and 213; SEQ ID NOs: 214, 215, 216, 217, 218 and 219; SEQ ID NOs: 214, 220, 216, 221, 218 and 219; SEQ ID NOs: 214, 220, 222, 221, 218 and 219; SEQ ID NOs: 223, 224, 225, 226, 227 and 228; or SEQ ID NOs: 229, 230, 231, 232, 233 and 234; SEQ ID NOs: 902, 903, 904, 905, 906 and 907; SEQ ID NOs: 908, 909, 910, 911, 912 and 913; SEQ ID NOs: 914, 915, 916, 917, 918 and 919; or SEQ ID NOs: 920, 921, 922, 923, 924 and 925.

In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to Chothia) set forth, respectively, in: SEQ ID NOs: 235, 236, 237, 238, 239 and 240; SEQ ID NOs: 241, 242, 243, 244, 239 and 245; SEQ ID NOs: 246, 242, 247, 244, 239 and 245; SEQ ID NOs: 248, 249, 250, 251, 239 and 252; SEQ ID NOs: 248, 249, 253, 251, 239 and 252; SEQ ID NOs: 254, 255, 256, 257, 258 and 259; SEQ ID NOs: 260, 261, 262, 263, 239 and 264; SEQ ID NOs: 265, 266, 267, 268, 269 and 270; SEQ ID NOs: 271, 272, 273, 274, 275 and 270; SEQ ID NOs: 271, 276, 277, 278, 275 and 279; SEQ ID NOs: 280, 281, 282, 283, 284 and 270; SEQ ID NOs: 285, 272, 286, 283, 275 and 270; SEQ ID NOs: 287, 288, 289, 290, 291 and 292; SEQ ID NOs: 293, 294, 295, 296, 297 and 298; SEQ ID NOs: 299, 300, 301, 302, 303 and 298; SEQ ID NOs: 304, 300, 305, 406, 307 and 298; SEQ ID NOs: 308, 309, 310, 311, 312 and 313; SEQ ID NOs: 314, 315, 316, 317, 318 and 165; SEQ ID NOs: 320, 315, 321, 317, 318 and 165; SEQ ID NOs: 322, 323, 324, 325, 326 and 327; SEQ ID NOs: 322, 328, 324, 325, 326 and 327; SEQ ID NOs: 329, 323, 330, 325, 326 and 327; SEQ ID NOs: 331, 332, 333, 334, 335 and 336; SEQ ID NOs: 337, 338, 339, 340, 341 and 342; SEQ ID NOs: 343, 344, 345, 346, 341 and 347; SEQ ID NOs:348, 349, 350, 351, 352 and 353; SEQ ID NOs: 354, 355, 356, 357, 358 and 359; SEQ ID NOs: 360, 361, 362, 363, 364 and 365; SEQ ID NOs: 366, 367, 368, 369, 370 and 371; SEQ ID NOs: 366, 361, 368, 369, 370 and 371; SEQ ID NOs: 372, 361, 373, 369, 370 and 371; SEQ ID NOs: 374, 375, 376, 377, 378 and 379; SEQ ID NOs: 380, 381, 382, 383, 384 and 385; SEQ ID NOs: 926, 927, 928, 929, 930 and 931; SEQ ID NOs: 932, 933, 934, 935, 936 and 937; SEQ ID NOs: 938, 939, 940, 941, 942 and 943; or SEQ ID NOs: 944, 945, 946, 947, 948 and 949.

In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to IMGT) set forth, respectively, in: SEQ ID NOs: 386, 387, 388, 389, 239 and 81; SEQ ID NOs: 390, 391, 392, 393, 239 and 87; SEQ ID NOs: 390, 391, 394, 393, 239 and 87; SEQ ID NOs: 395, 396, 397, 393, 239 and 87; SEQ ID NOs: 398, 399, 400, 401, 239 and 95; SEQ ID NOs: 398, 399, 402, 401, 239 and 95; SEQ ID NOs: 403, 404, 405, 406, 258 and 102; SEQ ID NOs: 407, 408, 409, 410, 239 and 107; SEQ ID NOs: 411, 412, 413, 414, 269 and 113; SEQ ID NOs: 415, 416, 417, 418, 275 and 119; SEQ ID NOs: 415, 419, 420, 421, 275 and 123; SEQ ID NOs: 422, 423, 424, 425, 275 and 113; SEQ ID NOs: 426, 416, 427, 425, 275 and 113; SEQ ID NOs: 428, 429, 430, 431, 291 and 137; SEQ ID NOs: 432, 433, 434, 435, 297 and 143; SEQ ID NOs: 436, 437, 438, 439, 303 and 143; SEQ ID NOs: 440, 437, 441, 442, 307 and 143; SEQ ID NOs: 443, 444, 445, 446, 312 and 159; SEQ ID NOs: 447, 448, 449, 450, 318 and 165; SEQ ID NOs: 451, 448, 452, 450, 318 and 165; SEQ ID NOs: 453, 454, 455, 456, 326 and 173; SEQ ID NOs: 453, 457, 455, 456, 326 and 173; SEQ ID NOs: 458, 459, 460, 456, 326 and 173; SEQ ID NOs: 461, 462, 463, 464, 335 and 183; SEQ ID NOs: 465, 466, 467, 468, 341 and 189; SEQ ID NOs: 469, 470, 471, 472, 341 and 195; SEQ ID NOs: 473, 474, 475, 476, 352 and 201; SEQ ID NOs: 477, 478, 479, 480, 358 and 207; SEQ ID NOs: 481, 482, 483, 484, 364 and 213; SEQ ID NOs: 485, 486, 487, 488, 370 and 219; SEQ ID NOs: 485, 482, 487, 488, 370 and 219; SEQ ID NOs: 489, 482, 490, 488, 370 and 219; SEQ ID NOs: 491, 492, 493, 494, 378 and 228; SEQ ID NOs: 495, 496, 497, 498, 384 and 234; SEQ ID NOs: 950, 951, 952, 953, 930 and 907; SEQ ID NOs: 954, 955, 956, 957, 936 and 913; SEQ ID NOs: 958, 959, 960, 961, 942 and 919; or SEQ ID NOs: 962, 963, 964, 965, 948 and 925.

In some embodiments, the second antigen binding domain comprises a second VH comprising a second VH-CDR1, a second VH-CDR2, and a second VH-CDR3; and a second VL comprising a second VL-CDR1, a second VL-CDR2, and a second VH-CDR3; comprising the amino acid sequences (according to Honegger) set forth, respectively, in: SEQ ID NOs: 499, 500, 501, 238, 502 and 240; SEQ ID NOs: 499, 503, 501, 238, 502 and 240; SEQ ID NOs: 505, 506, 507, 244, 502 and 245; SEQ ID NOs: 508, 509, 510, 244, 502 and 245; SEQ ID NOs: 511, 512, 513, 251, 514 and 252; SEQ ID NOs: 511, 512, 515, 251, 514 and 252; SEQ ID NOs: 516, 517, 518, 257, 519 and 259; SEQ ID NOs: 520, 521, 522, 264, 523 and 264; SEQ ID NOs: 524, 525, 526, 268, 527 and 270; SEQ ID NOs: 528, 529, 530, 274, 531 and 270; SEQ ID NOs: 528, 532, 533, 278, 531 and 279; SEQ ID NOs: 534, 535, 536, 283, 537 and 270; SEQ ID NOs: 1090, 529, 538, 283, 531 and 270; SEQ ID NOs: 539, 540, 541, 290, 542 and 292; SEQ ID NOs: 543, 544, 545, 546, 547 and 298; SEQ ID NOs: 548, 549, 550, 1091, 551 and 298; SEQ ID NOs: 552, 553, 554, 555, 556 and 298; SEQ ID NOs: 557, 558, 559, 311, 560 and 313; SEQ ID NOs: 561, 562, 563, 564, 565 and 165; SEQ ID NOs: 566, 562, 1092, 564, 567 and 165; SEQ ID NOs: 568, 569, 570, 571, 572 and 327; SEQ ID NOs: 568, 573, 570, 571, 572 and 327; SEQ ID NOs: 574, 575, 576, 571, 572 and 327; SEQ ID NOs: 577, 578, 579, 580, 581 and 336; SEQ ID NOs: 582, 583, 584, 340, 585 and 342; SEQ ID NOs: 586, 587, 588, 346, 589 and 347; SEQ ID NOs: 590, 591, 592, 351, 593 and 353; SEQ ID NOs: 594, 595, 596, 597, 598 and 359; SEQ ID NOs: 599, 600, 601, 602, 603 and 365; SEQ ID NOs: 604, 605, 606, 607, 608 and 371; SEQ ID NOs: 604, 609, 606, 607, 608 and 371; SEQ ID NOs: 610, 609, 611, 607, 608 and 371; SEQ ID NOs: 612, 613, 614, 615, 616 and 379; SEQ ID NOs: 617, 618, 619, 620, 621 and 385; SEQ ID NOs: 966, 967, 968, 969, 970 and 931; SEQ ID NOs: 971, 972, 973, 974, 975 and 937; SEQ ID NOs: 976, 977, 978, 941, 979 and 943; or SEQ ID NOs: 980, 981, 982, 983, 984 and 949.

In some embodiments, the second VH and the second VL comprise the amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively, in: SEQ ID NOs: 622 and 623; SEQ ID NOs: 624 and 625; SEQ ID NOs: 624 and 626; SEQ ID NOs: 627 and 628; SEQ ID NOs: 629 and 630; SEQ ID NOs: 631 and 632; SEQ ID NOs: 633 and 634; SEQ ID NOs: 635 and 636; SEQ ID NOs: 637 and 638; SEQ ID NOs: 639 and 640; SEQ ID NOs: 641 and 642; SEQ ID NOs: 643 and 644; SEQ ID NOs: 645 and 646; SEQ ID NOs: 647 and 648; SEQ ID NOs: 649 and 650; SEQ ID NOs: 651 and 652; SEQ ID NOs: 653 and 654; SEQ ID NOs: 655 and 656; SEQ ID NOs: 657 and 658; SEQ ID NOs: 659 and 660; SEQ ID NOs: 661 and 662; SEQ ID NOs: 663 and 664; SEQ ID NOs: 665 and 666; SEQ ID NOs: 667 and 668; SEQ ID NOs: 669 and 670; SEQ ID NOs:671 and 672; SEQ ID NOs:673 and 670; SEQ ID NOs: 674 and 675; SEQ ID NOs: 676 and 677; SEQ ID NOs: 678 and 679; SEQ ID NOs: 680 and 681; SEQ ID NOs: 682 and 683; SEQ ID NOs: 684 and 685; SEQ ID NOs: 686 and 687; SEQ ID NOs: 688 and 689; SEQ ID NOs: 690 and 691; SEQ ID NOs: 692 and 693; SEQ ID NOs: 694 and 695; SEQ ID NOs: 985 and 986; SEQ ID NOs: 987 and 988; SEQ ID NOs: 989 and 990; or SEQ ID NOs: 991 and 992.

Illustrative sequences of complementarity determining regions (CDRs) of the first antigen binding domains of the multi-specific antigen binding molecules, targeting HIV gp120, are provided in Tables D1, D2, D3 and D4. Illustrative sequences of the VH and VL of the second antigen binding domains of the multi-specific antigen binding molecules, targeting HIV gp120, are provided in Table E.

TABLE D1

CDRs (Kabat) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 1 | DSYWS SEQ ID NO: 76 | YVHKSGDTNYSPSLKS SEQ ID NO: 77 | TLHGRRIYGIVAFN EWFTYFYMDV SEQ ID NO: 78 | GEKSLGSRAVQ SEQ ID NO: 79 | NNQDRPS SEQ ID NO: 80 | HIWDSRVPTKWV SEQ ID NO: 81 |
| 2 | DSYWS SEQ ID NO: 76 | YVHKSGDTNYNPSLKS SEQ ID NO: 82 | TLHGRRIYGIVAFN EWFTYFYMDV SEQ ID NO: 78 | GEKSLGSRAVQ SEQ ID NO: 79 | NNQDRPS SEQ ID NO: 80 | HIWDSRVPTKWV SEQ ID NO: 81 |
| 3 | NYYWT SEQ ID NO: 83 | YISDRESATYNPSLNS SEQ ID NO: 84 | ARRGQRIYGVVSFG EFFYYYSMDV SEQ ID NO: 85 | GRQALGSRAVQ SEQ ID NO: 86 | NNQDRPS SEQ ID NO: 80 | HMWDSRSGFSWS SEQ ID NO: 87 |
| 4 | NYYWT SEQ ID NO: 83 | YISDRETTTYNPSLNS SEQ ID NO: 88 | ARRGQRIYGVVSFG EFFYYYYMDV SEQ ID NO: 89 | GRQALGSRAVQ SEQ ID NO: 86 | NNQDRPS SEQ ID NO: 80 | HMWDSRSGFSWS SEQ ID NO: 87 |
| 5 | GRFWS SEQ ID NO: 90 | YFSDTDRSEYNPSLRS SEQ ID NO: 91 | AQQGKRIYGIVSFG EFFYYYYMDA SEQ ID NO: 92 | GERSRGSRAVQ SEQ ID NO: 93 | NNQDRPA SEQ ID NO: 94 | HYWDSRSPISWI SEQ ID NO: 95 |
| 6 | GRFWS SEQ ID NO: 90 | YFSDTDRSEYNPSLRS SEQ ID NO: 91 | AQQGKRIYGIVSFG ELFYYYYMDA SEQ ID NO: 96 | GERSRGSRAVQ SEQ ID NO: 93 | NNQDRPA SEQ ID NO: 94 | HYWDSRSPISWI SEQ ID NO: 95 |
| 7 | DNYWS SEQ ID NO: 97 | YVHDSGDTNYNPSLKS SEQ ID NO: 98 | TKHGRRIYGVVAFK EWFTYFYMDV SEQ ID NO: 99 | GEESLGSRSVI SEQ ID NO: 100 | NNNDRPS SEQ ID NO: 101 | HIWDSRRPTNWV SEQ ID NO: 102 |
| 8 | DAYWS SEQ ID NO: 103 | YVHHSGDTNYNPSLKR SEQ ID NO: 104 | ALHGKRIYGIVALG ELFTYFYMDV SEQ ID NO: 105 | GKESIGSRAVQ SEQ ID NO: 106 | NNQDRPA SEQ ID NO: 94 | HIYDARGGTNWV SEQ ID NO: 107 |
| 9 | ACTYFWG SEQ ID NO: 108 | SLSHCQSFWGSGWTFH NPSLKS SEQ ID NO: 109 | FDGEVLVYNHWPKP AWVDL SEQ ID NO: 110 | NGTATNFVS SEQ ID NO: 111 | GVDKRPP SEQ ID NO: 112 | GSLVGNWDVI SEQ ID NO: 113 |
| 10 | ACDYFWG SEQ ID NO: 114 | GLSHCAGYYNTGWTYH NPSLKS SEQ ID NO: 115 | FDGEVLVYHDWPKP AWVDL SEQ ID NO: 116 | TGTSNRFVS SEQ ID NO: 117 | GVNKRPS SEQ ID NO: 118 | SSLVGNWDVI SEQ ID NO: 119 |
| 11 | ACDYFWG SEQ ID NO: 114 | SLSHCAGYYNSGWTYH NPSLKS SEQ ID NO: 120 | FGGDVLVYHDWPKP AWVDL SEQ ID NO: 121 | TGNINNFVS SEQ ID NO: 122 | GVNKRPS SEQ ID NO: 118 | GSLAGNWDVV SEQ ID NO: 123 |

TABLE D1-continued

CDRs (Kabat) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 12 | ACNSFWG SEQ ID NO: 124 | SLSHCASYWNRGWTYH NPSLKS SEQ ID NO: 125 | FGGEVLRYTDWPKP AWVDL SEQ ID NO: 126 | TGTSNNFVS SEQ ID NO: 127 | DVNKRPS SEQ ID NO: 128 | GSLVGNWDVI SEQ ID NO: 113 |
| 13 | GCDYFWG SEQ ID NO: 129 | GLSHCAGYYNTGWTYH NPSLKS SEQ ID NO: 115 | FDGEVLVYNDWPKP AWVDL SEQ ID NO: 131 | TGTSNNFVS SEQ ID NO: 127 | GVNKRPS SEQ ID NO: 118 | GSLVGNWDVI SEQ ID NO: 113 |
| 14 | TGHYYWG SEQ ID NO: 132 | HIHYTTAVLHNPSLKS SEQ ID NO: 133 | SGGDILYYYEWQKP HWFSP SEQ ID NO: 134 | NGTSSDIGGWNFVS SEQ ID NO: 135 | EVNKRPS SEQ ID NO: 136 | SSLFGRWDVV SEQ ID NO: 137 |
| 15 | GTDWGENDFHYG SEQ ID NO: 138 | SIHWRGRTTHYKTSFR S SEQ ID NO: 139 | HKYHDIFRVVPVAG WFDP SEQ ID NO: 140 | RASQNVKNNLA SEQ ID NO: 141 | DASSRAG SEQ ID NO: 142 | QQYEEWPRT SEQ ID NO: 143 |
| 16 | GGEWGDSDYHWG SEQ ID NO: 144 | SIHWRGTTHYNAPFRG SEQ ID NO: 145 | HKYHDIVMVVPIAG WFDP SEQ ID NO: 146 | RASQSVKNNLA SEQ ID NO: 147 | DTSSRAS SEQ ID NO: 148 | QQYEEWPRT SEQ ID NO: 143 |
| 17 | GGEWGDKDYHWG SEQ ID NO: 149 | SIHWRGTTHYKESLRR SEQ ID NO: 150 | HRHHDVFMLVPIAG WFDV SEQ ID NO: 151 | RASQNINKNLA SEQ ID NO: 152 | ETYSKIA SEQ ID NO: 153 | QQYEEWPRT SEQ ID NO: 143 |
| 18 | SDHSWT SEQ ID NO: 154 | DIHYNGATTYNPSLRS SEQ ID NO: 155 | NAIRIYGVVALGEW FHYGMDV SEQ ID NO: 156 | SGAPLTSRFTY SEQ ID NO: 157 | RSSQRSS SEQ ID NO: 158 | QSSDTSDSYKM SEQ ID NO: 159 |
| 19 | DYFIH SEQ ID NO: 160 | WINPKTGQPNNPRQFQ G SEQ ID NO: 161 | QRSDYWDFDV SEQ ID NO: 162 | QANGYLN SEQ ID NO: 163 | DGSKLER SEQ ID NO: 164 | QVYEF SEQ ID NO: 165 |
| 20 | DHFIH SEQ ID NO: 166 | WINPKTGQPNNPRQFQ G SEQ ID NO: 161 | QRSDFWDFDV SEQ ID NO: 167 | QANGYLN SEQ ID NO: 163 | DGSKLER SEQ ID NO: 164 | QVYEF SEQ ID NO: 165 |
| 21 | NCPIN SEQ ID NO: 168 | WMKPRGGAVSYARQLQ G SEQ ID NO: 169 | GKYCTARDYYNWDF EH SEQ ID NO: 170 | RTSQYGSLA SEQ ID NO: 171 | SGSTRAA SEQ ID NO: 172 | QQYEF SEQ ID NO: 173 |
| 22 | NCPIN SEQ ID NO: 168 | WMKPRHGAVSYARQLQ G SEQ ID NO: 174 | GKYCTARDYYNWDF EH SEQ ID NO: 170 | RTSQYGSLA SEQ ID NO: 171 | SGSTRAA SEQ ID NO: 172 | QQYEF SEQ ID NO: 173 |
| 23 | DCTLN SEQ ID NO: 175 | WLKPRGGAVNYARPLQ GSEQ ID NO: 176 | GKNCDYNWDFEH SEQ ID NO: 177 | RTSQYGSLA SEQ ID NO: 171 | SGSTRAA SEQ ID NO: 172 | QQYEF SEQ ID NO: 173 |
| 24 | AHILF SEQ ID NO: 178 | WIKPQYGAVNFGGGFR DSEQ ID NO: 179 | DRSYGDSSWALDA SEQ ID NO: 180 | QTSQGVGSDLH SEQ ID NO: 181 | HTSSVED SEQ ID NO: 182 | QVLQF SEQ ID NO: 183 |
| 25 | DDDTFTKYWTH SEQ ID NO: 902 | VISPHFARPIYSYKFR D SEQ ID NO: 903 | DPFGDRAPHYNYHM DV SEQ ID NO: 904 | RASQGLDSSHLA SEQ ID NO: 905 | GTSNRAR SEQ ID NO: 906 | QRYGGTPIT SEQ ID NO: 907 |
| 26 | RTELIH SEQ ID NO: 908 | WVKTVTGAVNFGSPDF R SEQ ID NO: 909 | QKFYTGGQGWYFDL SEQ ID NO: 910 | TAASYGHMT SEQ ID NO: 911 | ATSKRAS SEQ ID NO: 912 | QQLEF SEQ ID NO: 913 |
| 27 | SGFDFSRQGMH SEQ ID NO: 184 | FIKYDGSEKYHADSVW SEQ ID NO: 185 | EAGGPDYRNGYNYY DFYDGYYNYHMDV SEQ ID NO: 186 | NGTSNDVGGYESVS SEQ ID NO: 187 | DVSKRPS G SEQ ID NO: 188 | KSLTSTRRRV SEQ ID NO: 189 |
| 28 | SGFTFHKYGMH SEQ ID NO: 190 | LISDDGMRKYHSDSMW SEQ ID NO: 191 | EAGGPIWHDDVKYY DFNDGYYNYHMDV SEQ ID NO: 192 | NGTSSDVGGFDSVS SEQ ID NO: 193 | DVSHRPS G SEQ ID NO: 194 | SSLTDRSHRI SEQ ID NO: 195 |
| 29 | DYYLH SEQ ID NO: 196 | LIDPENGEARYAEKFQ G SEQ ID NO: 197 | GAVGADSGSWFDP SEQ ID NO: 198 | SGSKLGDKYVS SEQ ID NO: 199 | ENDRRPS SEQ ID NO: 200 | QAWETTTTFV SEQ ID NO: 201 |

TABLE D1-continued

CDRs (Kabat) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 30 | SYAFS SEQ ID NO: 202 | MITPVFGETKYAPRFQG SEQ ID NO: 203 | DRRVVPMATDNWLDP SEQ ID NO: 204 | RASQTIHTYLN SEQ ID NO: 205 | GASTLQS SEQ ID NO: 206 | QQSYSTPRT SEQ ID NO: 207 |
| 31 | NHDVH SEQ ID NO: 208 | WMSHEGDKTGLAQKFQG SEQ ID NO: 209 | GSKHRLRDYFLYNEYGPNYEEWGDYLATLDV SEQ ID NO: 210 | KCSHSLQHSTGANYLA SEQ ID NO: 211 | LATHRAS SEQ ID NO: 212 | MQGLHSPWT SEQ ID NO: 213 |
| 32 | KYDVH SEQ ID NO: 214 | WISHERDKTESAQRFK SEQ ID NO: 215 | GSKHRLRDYVLYDDYGLINYQEWNDYLEFLDV SEQ ID NO: 216 | SSTQSLRHSNGANYLA SEQ ID NO: 217 | LGSQRAS SEQ ID NO: 218 | MQGLNRPWT SEQ ID NO: 219 |
| 33 | KYDVH SEQ ID NO: 214 | WMSHEGDKTESAQRFK SEQ ID NO: 220 | GSKHRLRDYVLYDDYGLINYQEWNDYLEFLDV SEQ ID NO: 216 | TSTQSLRHSNGANYLA SEQ ID NO: 221 | LGSQRAS SEQ ID NO: 218 | MQGLNRPWT SEQ ID NO: 219 |
| 34 | KYDVH SEQ ID NO: 214 | WMSHEGDKTESAQRFK SEQ ID NO: 220 | GSKHRLRDYVLYDDYGLINQQEWNDYLEFLDV SEQ ID NO: 222 | TSTQSLRHSNGANYLA SEQ ID NO: 221 | LGSQRAS SEQ ID NO: 218 | MQGLNRPWT SEQ ID NO: 219 |
| 35 | GYGMH SEQ ID NO: 914 | SISHDGIKKYHAEKVWG SEQ ID NO: 915 | DLREDECEEWWSDYYDFGKQLPCAKSRGGLVGIADN SEQ ID NO: 916 | SGNTSNIGNNFVS SEQ ID NO: 917 | ETDKRPS SEQ ID NO: 918 | ATWAASLSSARV SEQ ID NO: 919 |
| 36 | KYPMY SEQ ID NO: 223 | AISGDAWHVVYSNSVQG SEQ ID NO: 224 | MFQESGPPRLDRWSGRNYYYYSGMDV SEQ ID NO: 225 | KSSESLRQSNGKTSLY SEQ ID NO: 226 | EVSNRFS SEQ ID NO: 227 | MQSKDFPLT SEQ ID NO: 228 |
| 37 | GLYAVN SEQ ID NO: 229 | QIWRWKSSASHHFRG SEQ ID NO: 230 | TSTYDKWSGLHHDGVMAFSS SEQ ID NO: 231 | RASQSITGNWVA SEQ ID NO: 232 | RGAALLG SEQ ID NO: 233 | QQYDTYPGT SEQ ID NO: 234 |
| 38 | NDNYYWA SEQ ID NO: 920 | TIYYSGTTYYNPSLRN SEQ ID NO: 921 | MPSHGFWSTSFSYWYFDL SEQ ID NO: 922 | RASQSVTKYLN SEQ ID NO: 923 | GTYTLLS SEQ ID NO: 924 | QQAHSTPWT SEQ ID NO: 925 |

TABLE D2

CDRs (Chothia) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 39 | GASISD SEQ ID NO: 235 | KSG SEQ ID NO: 236 | LHGRRIYGIVAFNEWFTYFYMD SEQ ID NO: 237 | EKSLGSRA SEQ ID NO: 238 | NNQ SEQ ID NO: 239 | WDSRVPTKW SEQ ID NO: 240 |
| 40 | GDSMNNY SEQ ID NO: 241 | DRE SEQ ID NO: 242 | RRGQRIYGVVSFGEFFYYYSMD SEQ ID NO: 243 | RQALGSRA SEQ ID NO: 244 | NNQ SEQ ID NO: 239 | WDSRSGFSW SEQ ID NO: 245 |
| 41 | GGSISNY SEQ ID NO: 246 | DRE SEQ ID NO: 242 | RRGQRIYGVVSFGEFFYYYYMD SEQ ID NO: 247 | RQALGSRA SEQ ID NO: 244 | NNQ SEQ ID NO: 239 | WDSRSGFSW SEQ ID NO: 245 |
| 42 | NGSVSGR SEQ ID NO: 248 | DTD SEQ ID NO: 249 | QQGKRIYGIVSFGEFFYYYYMD SEQ ID NO: 250 | ERSRGSRA SEQ ID NO: 251 | NNQ SEQ ID NO: 239 | WDSRSPISW SEQ ID NO: 252 |
| 43 | NGSVSGR SEQ ID NO: 248 | DTD SEQ ID NO: 249 | QQGKRIYGIVSFGELFYYYYMD SEQ ID NO: 253 | ERSRGSRA SEQ ID NO: 251 | NNQ SEQ ID NO: 239 | WDSRSPISW SEQ ID 2 25 |
| 44 | GTLVRDN SEQ ID NO: 254 | DSG SEQ ID NO: 255 | KHGRRIYGVVAFKEWFTYFYMD SEQ ID NO: 256 | EESLGSRS SEQ ID NO: 257 | NNN SEQ ID NO: 258 | WDSRRPTNW SEQ ID NO: 259 |

TABLE D2-continued

CDRs (Chothia) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 45 | GASINDA SEQ ID NO: 260 | HSG SEQ ID NO: 261 | LHGKRIYGIVALGELFT YFYMD SEQ ID NO: 262 | KESIGSRA SEQ ID NO: 263 | NNQ SEQ ID NO: 239 | YDARGGTNW SEQ ID NO: 264 |
| 46 | GESTGACTY SEQ ID NO: 265 | HCQSFWGSG SEQ ID NO: 266 | DGEVLVYNHWPKPAWVD SEQ ID NO: 267 | GTATNF SEQ ID NO: 268 | GVD SEQ ID NO: 269 | LVGNWDV SEQ ID NO: 270 |
| 47 | GDSTAACDY SEQ ID NO: 271 | HCAGYYNTG SEQ ID NO: 272 | DGEVLVYHDWPKPAWVD SEQ ID NO: 273 | GTSNRF SEQ ID NO: 274 | GVN SEQ ID NO: 275 | LVGNWDV SEQ ID NO: 270 |
| 48 | GDSTAACDY SEQ ID NO: 271 | HCAGYYNSG SEQ ID NO: 276 | GGDVLVYHDWPKPAWVD SEQ ID NO: 277 | GNINNF SEQ ID NO: 278 | GVN SEQ ID NO: 275 | LAGNWDV SEQ ID NO: 279 |
| 49 | GDSTAACNS SEQ ID NO: 280 | HCASYWNRG SEQ ID NO: 281 | GGEVLRYTDWPKPAWVD SEQ ID NO: 282 | GTSNNF SEQ ID NO: 283 | DVN SEQ ID NO: 284 | LVGNWDV SEQ ID NO: 270 |
| 50 | GDSTAGCDY SEQ ID NO: 285 | HCAGYYNTG SEQ ID NO: 272 | DGEVLVYNDWPKPAWVD SEQ ID NO: 286 | GTSNNF SEQ ID NO: 283 | GVN SEQ ID NO: 275 | LVGNWDV SEQ ID NO: 270 |
| 51 | GESINTGHY SEQ ID NO: 287 | YTT SEQ ID NO: 288 | GGDILYYYEWQKPHWFS SEQ ID NO: 289 | GTSSDIGGWNF SEQ ID NO: 290 | EVN SEQ ID NO: 291 | LFGRWDV SEQ ID NO: 292 |
| 52 | GGSMRGTDW GENDF SEQ ID NO: 293 | WRGR SEQ ID NO: 294 | KYHDIFRVVPVAGWFD SEQ ID NO: 295 | SQNVKNN SEQ ID NO: 296 | DAS SEQ ID NO: 297 | YEEWPR SEQ ID NO: 298 |
| 53 | GGSIRGGEW GDSDY SEQ ID NO: 299 | WRG SEQ ID NO: 300 | KYHDIVMVVPIAGWFD SEQ ID NO: 301 | SQSVKNN SEQ ID NO: 302 | DTS SEQ ID NO: 303 | YEEWPR SEQ ID NO: 298 |
| 54 | GDSIRGGEW GDKDY SEQ ID NO: 304 | WRG SEQ ID NO: 300 | RHHDVFMLVPIAGWFD SEQ ID NO: 305 | SQNINKN SEQ ID NO: 306 | ETY SEQ ID NO: 307 | YEEWPR SEQ ID NO: 298 |
| 55 | QDSRPSDH SEQ ID NO: 308 | YNG SEQ ID NO: 309 | AIRIYGVVALGEWFHYG MD SEQ ID NO: 310 | GAPLTSRF SEQ ID NO: 311 | RSS SEQ ID NO: 312 | SDTSDSYK SEQ ID NO: 313 |
| 56 | GYNIRDY SEQ ID NO: 314 | PKTG SEQ ID NO: 315 | RSDYWDFD SEQ ID NO: 316 | NGY SEQ ID NO: 317 | DGS SEQ ID NO: 318 | YE SEQ ID NO: 327 |
| 57 | GYKISDH SEQ ID NO: 320 | PKTG SEQ ID NO: 315 | RSDFWDFD SEQ ID NO: 321 | NGY SEQ ID NO: 317 | DGS SEQ ID NO: 318 | YE SEQ ID NO: 327 |
| 58 | GYEFINC SEQ ID NO: 322 | PRGG SEQ ID NO: 323 | KYCTARDYYNWDFE SEQ ID NO: 324 | SQYGS SEQ ID NO: 325 | SGS SEQ ID NO: 326 | YE SEQ ID NO: 327 |
| 59 | GYEFINC SEQ ID NO: 322 | PRHG SEQ ID NO: 328 | KYCTARDYYNWDFE SEQ ID NO: 324 | SQYGS SEQ ID NO: 325 | SGS SEQ ID NO: 326 | YE SEQ ID NO: 327 |
| 60 | GYEFIDC SEQ ID NO: 329 | PRGG SEQ ID NO: 323 | KNCDYNWDFE SEQ ID NO: 330 | SQYGS SEQ ID NO: 325 | SGS SEQ ID NO: 326 | YE SEQ ID NO: 327 |
| 61 | GYTFTAH SEQ ID NO: 331 | PQYG SEQ ID NO: 332 | RSYGDSSWALD SEQ ID NO: 333 | SQGVGSD SEQ ID NO: 334 | HTS SEQ ID NO: 335 | LQ SEQ ID NO: 336 |
| 62 | DDPYTDDDT FTKY SEQ ID NO: 926 | PHFA SEQ ID NO: 927 | PFGDRAPHYNYHMD SEQ ID NO: 928 | SQGLDSSH SEQ ID NO: 929 | GTS SEQ ID NO: 930 | YGGTPI SEQ ID NO: 931 |

TABLE D2-continued

CDRs (Chothia) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 63 | EDIFERTE SEQ ID NO: 932 | TVTG SEQ ID NO: 933 | KFYTGGQGWYFD SEQ ID NO: 934 | ASYGH SEQ ID NO: 935 | ATS SEQ ID NO: 936 | LE SEQ ID NO: 937 |
| 64 | GFDFSRQ SEQ ID NO: 337 | YDGS SEQ ID NO: 338 | AGGPDYRNGYNYYDFYD GYYNYHYMD SEQ ID NO: 339 | GTSNDVGGYES SEQ ID NO: 340 | DVS SEQ ID NO: 341 | LTSTRRR SEQ ID NO: 342 |
| 65 | GFTFHKY SEQ ID NO: 343 | DDGM SEQ ID NO: 344 | AGGPIWHDDVKYYDFND GYYNYHYMD SEQ ID NO: 345 | GTSSDVGGFDS SEQ ID NO: 346 | DVS SEQ ID NO: 341 | LTDRSHR SEQ ID NO: 347 |
| 66 | GYSFIDY SEQ ID NO: 348 | PENG SEQ ID NO: 349 | AVGADSGSWFD SEQ ID NO: 350 | GSKLGDKY SEQ ID NO: 351 | END SEQ ID NO: 352 | WETTTTF SEQ ID NO: 353 |
| 67 | GGAFSSY SEQ ID NO: 354 | PVFG SEQ ID NO: 355 | RRVVPMATDNWLD SEQ ID NO: 356 | SQTIHTY SEQ ID NO: 357 | GAS SEQ ID NO: 358 | SYSTPR SEQ ID NO: 359 |
| 68 | GNSFSNH SEQ ID NO: 360 | HEGD SEQ ID NO: 361 | SKHRLRDYFLYNEYGPN YEEWGDYLATLD SEQ ID NO: 362 | SHSLQHSTGANY SEQ ID NO: 363 | LAT SEQ ID NO: 364 | GLHSPW SEQ ID NO: 365 |
| 69 | GNTFSKY SEQ ID NO: 366 | HERD SEQ ID NO: 367 | SKHRLRDYVLYDDYGLI NYQEWNDYLEFLD SEQ ID NO: 368 | TQSLRHSNGANY SEQ ID NO: 369 | LGS SEQ ID NO: 370 | GLNRPW SEQ ID NO: 371 |
| 70 | GNTFSKY SEQ ID NO: 366 | HEGD SEQ ID NO: 361 | SKHRLRDYVLYDDYGLI NYQEWNDYLEFLD SEQ ID NO: 368 | TQSLRHSNGANY SEQ ID NO: 369 | LGS SEQ ID NO: 370 | GLNRPW SEQ ID NO: 371 |
| 71 | GNTFRKY SEQ ID NO: 372 | HEGD SEQ ID NO: 361 | SKHRLRDYVLYDDYGLI NQQEWNDYLEFLD SEQ ID NO: 373 | TQSLRHSNGANY SEQ ID NO: 369 | LGS SEQ ID NO: 370 | GLNRPW SEQ ID NO: 371 |
| 72 | QFRFDGY SEQ ID NO: 938 | HDGI SEQ ID NO: 939 | LREDECEEWWSDYYDFG KQLPCAKSRGGLVGIAD SEQ ID NO: 940 | GNTSNIGNNF SEQ ID NO: 941 | ETD SEQ ID NO: 942 | WAASLSSAR SEQ ID NO: 943 |
| 73 | DFPFSKY SEQ ID NO: 374 | GDAW SEQ ID NO: 375 | FQESGPPRLDRWSGRNY YYYSGMD SEQ ID NO: 376 | SESLRQSNGKTS SEQ ID NO: 377 | EVS SEQ ID NO: 378 | SKDFPL SEQ ID NO: 379 |
| 74 | GVNTFGLY SEQ ID NO: 380 | RW SEQ ID NO: 381 | STYDKWSGLHHDGVMAF S SEQ ID NO: 382 | SQSITGNW SEQ ID NO: 383 | RGA SEQ ID NO: 384 | YDTYPG SEQ ID NO: 385 |
| 75 | GDSVSNDNY SEQ ID NO: 944 | YSG SEQ ID NO: 945 | PSHGFWSTSFSYWYFD SEQ ID NO: 946 | SQSVTKY SEQ ID NO: 947 | GTY SEQ ID NO: 948 | AHSTPW SEQ ID NO: 949 |

TABLE D3

CDRs (IMGT) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 76 | GASISDSY SEQ ID NO: 386 | VHKSGDT SEQ ID NO: 387 | ARTLHGRRIYGIVAFNEWFTYFYMDV SEQ ID NO: 388 | SLGSRA SEQ ID NO: 389 | NNQ SEQ ID NO: 239 | HIWDSRVPTKWV SEQ ID NO: 81 |
| 77 | GDSMNNYY SEQ ID NO: 390 | ISDRESA SEQ ID NO: 391 | ATARRGQRIYGVVSFGEFFYYYSMDV SEQ ID NO: 392 | ALGSRA SEQ ID NO: 393 | NNQ SEQ ID NO: 239 | HMWDSRSGFSWS SEQ ID NO: 87 |
| 78 | GDSMNNYY SEQ ID NO: 390 | ISDRESA SEQ ID NO: 391 | ARARRGQRIYGVVSFGEFFYYYSMDV SEQ ID NO: 394 | ALGSRA SEQ ID NO: 393 | NNQ SEQ ID NO: 239 | HMWDSRSGFSWS SEQ ID NO: 87 |

TABLE D3-continued

CDRs (IMGT) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 79 | GGSISNYY SEQ ID NO: 395 | ISDRETT SEQ ID NO: 396 | ATARRGQRIYGVVSFGEFFYYYYMDV SEQ ID NO: 397 | ALGSRA SEQ ID NO: 393 | NNQ SEQ ID NO: 239 | HMWDSRSGFSWS SEQ ID NO: 87 |
| 80 | NGSVSGRF SEQ ID NO: 398 | FSDTDRS SEQ ID NO: 399 | ARAQQGKRIYGIVSFGELFYYYYMDA SEQ ID NO: 400 | SRGSRA SEQ ID NO: 401 | NNQ SEQ ID NO: 239 | HYWDSRSPISWI SEQ ID NO: 95 |
| 81 | NGSVSGRF SEQ ID NO: 398 | FSDTDRS SEQ ID NO: 399 | ARAQQGKRIYGIVSFGEFFYYYYMDA SEQ ID NO: 402 | SRGSRA SEQ ID NO: 401 | NNQ SEQ ID NO: 239 | HYWDSRSPISWI SEQ ID NO: 95 |
| 82 | GASINDAY SEQ ID NO: 403 | VHHSGDT SEQ ID NO: 404 | ARALHGKRIYGIVALGELFTYYMDV SEQ ID NO: 405 | SLGSRS SEQ ID NO: 406 | NNN SEQ ID NO: 258 | HIWDSRRPTNWV SEQ ID NO: 102 |
| 83 | GTLVRDNY SEQ ID NO: 407 | VHDSGDT SEQ ID NO: 408 | ATTKHGRRIYGVVAFKEWFTYYMDV SEQ ID NO: 409 | SIGSRA SEQ ID NO: 410 | NNQ SEQ ID NO: 239 | HIYDARGGTNWV SEQ ID NO: 107 |
| 84 | GESTGACTYF SEQ ID NO: 411 | LSHCQSFWGSGWT SEQ ID NO: 412 | ARFDGEVLVYNHWPKPAWVDL SEQ ID NO: 413 | ATNF SEQ ID NO: 414 | GVD SEQ ID NO: 269 | GSLVGNWDVI SEQ ID NO: 113 |
| 85 | GDSTAACDYF SEQ ID NO: 415 | LSHCAGYYNTGWT SEQ ID NO: 416 | ARFDGEVLVYHDWPKPAWVDL SEQ ID NO: 417 | SNRF SEQ ID NO: 418 | GVN SEQ ID NO: 275 | SSLVGNWDVI SEQ ID NO: 119 |
| 86 | GDSTAACDYF SEQ ID NO: 415 | LSHCAGYYNSGWT SEQ ID NO: 419 | ARFGGDVLVYHDWPKPAWVDL SEQ ID NO: 420 | INNF SEQ ID NO: 421 | GVN SEQ ID NO: 275 | GSLAGNWDVV SEQ ID NO: 123 |
| 87 | GDSTAACNSF SEQ ID NO: 422 | LSHCASYWNRGWT SEQ ID NO: 423 | ARFGGEVLRYTDWPKPAWVDL SEQ ID NO: 424 | SNNF SEQ ID NO: 425 | DVN SEQ ID NO: 284 | GSLVGNWDVI SEQ ID NO: 113 |
| 88 | GDSTAGCDYF SEQ ID NO: 426 | LSHCAGYYNTGWT SEQ ID NO: 416 | ARFDGEVLVYNDWPKPAWVDL SEQ ID NO: 427 | SNNF SEQ ID NO: 425 | GVN SEQ ID NO: 275 | GSLVGNWDVI SEQ ID NO: 113 |
| 89 | GESINTGHYY SEQ ID NO: 428 | IHYTTAV SEQ ID NO: 429 | VRSGGDILYYYEWQKPHWFSP SEQ ID NO: 430 | SSDIGGWNF SEQ ID NO: 431 | EVN SEQ ID NO: 291 | SSLFGRWDVV SEQ ID NO: 137 |
| 90 | GGSMRGTDWG ENDFH SEQ ID NO: 432 | IHWRGRTT SEQ ID NO: 433 | ARHKYHDIFRVVPVAGWFDP SEQ ID NO: 434 | QNVKNN SEQ ID NO: 435 | DAS SEQ ID NO: 297 | QQYEEWPRT SEQ ID NO: 143 |
| 91 | GGSIRGGEWG DSDYH SEQ ID NO: 436 | IHWRGTT SEQ ID NO: 437 | VKHKYHDIVMVVPIAGWFDP SEQ ID NO: 438 | QSVKNN SEQ ID NO: 439 | DTS SEQ ID NO: 303 | QQYEEWPRT SEQ ID NO: 143 |
| 92 | GDSIRGGEWG DKDYH SEQ ID NO: 440 | IHWRGTT SEQ ID NO: 437 | ARHRHHDVFMLVPIAGWFDV SEQ ID NO: 441 | QNINKN SEQ ID NO: 442 | ETY SEQ ID NO: 307 | QQYEEWPRT SEQ ID NO: 143 |
| 93 | QDSRPSDHS SEQ ID NO: 443 | IHYNGAT SEQ ID NO: 444 | NAIRIYGVVALGEWFHYGMDV SEQ ID NO: 445 | PLTSRF SEQ ID NO: 446 | RSS SEQ ID NO: 312 | QSSDTSDSYKM SEQ ID NO: 159 |
| 94 | GYNIRDYF SEQ ID NO: 447 | INPKTGQP SEQ ID NO: 448 | ARQRSDYWDFDV SEQ ID NO: 449 | NGY SEQ ID NO: 450 | DGS SEQ ID NO: 318 | QVYEF SEQ ID NO: 165 |
| 95 | GYKISDHF SEQ ID NO: 451 | INPKTGQP SEQ ID NO: 448 | ARQRSDFWDFDV SEQ ID NO: 452 | NGY SEQ ID NO: 450 | DGS SEQ ID NO: 318 | QVYEF SEQ ID NO: 165 |
| 96 | GYEFINCP SEQ ID NO: 453 | MKPRGGAV SEQ ID NO: 454 | TRGKYCTARDYYNWDFEH SEQ ID NO: 455 | QYGS SEQ ID NO: 456 | SGS SEQ ID NO: 326 | QQYEF SEQ ID NO: 173 |

TABLE D3-continued

CDRs (IMGT) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 97 | GYEFINCP SEQ ID NO: 453 | MKPRHGAV SEQ ID NO: 457 | TRGKYCTARDYYNWDFEH SEQ ID NO: 455 | QYGS SEQ ID NO: 456 | SGS SEQ ID NO: 326 | QQYEF SEQ ID NO: 173 |
| 98 | GYEFIDCT SEQ ID NO: 458 | LKPRGGAV SEQ ID NO: 459 | TRGKNCDYNWDFEH SEQ ID NO: 460 | QYGS SEQ ID NO: 456 | SGS SEQ ID NO: 326 | QQYEF SEQ ID NO: 173 |
| 99 | GYTFTAHI SEQ ID NO: 461 | IKPQYGAV SEQ ID NO: 462 | ARDRSYGDSSWALDA SEQ ID NO: 463 | QGVGSD SEQ ID NO: 464 | HTS SEQ ID NO: 335 | QVLQF SEQ ID NO: 183 |
| 100 | DDPYTDDDTF TKYW SEQ ID NO: 950 | ISPHFARP SEQ ID NO: 951 | ARDPFGDRAPHYNYHMDV SEQ ID NO: 952 | QGLDSSH SEQ ID NO: 953 | GTS SEQ ID NO: 930 | QRYGGTPIT SEQ ID NO: 907 |
| 101 | EDIFERTEL SEQ ID NO: 954 | VKTVTGAV SEQ ID NO: 955 | ARQKFYTGGQGWYFDL SEQ ID NO: 956 | SYGH SEQ ID NO: 957 | ATS SEQ ID NO: 936 | QQLEF SEQ ID NO: 913 |
| 102 | GFDFSRQG SEQ ID NO: 465 | IKYDGSEK SEQ ID NO: 466 | VREAGGPDYRNGYNYYDFYDGYYNYH YMDV SEQ ID NO: 467 | SNDVGGYES SEQ ID NO: 468 | DVS SEQ ID NO: 341 | KSLTSTRRRV SEQ ID NO: 189 |
| 103 | GFTFHKYG SEQ ID NO: 469 | ISDDGMRK SEQ ID NO: 470 | AREAGGPIWHDDVKYYDFNDGYYNYH YMDV SEQ ID NO: 471 | SSDVGGFDS SEQ ID NO: 472 | DVS SEQ ID NO: 341 | SSLTDRSHRI SEQ ID NO: 195 |
| 104 | GYSFIDYY SEQ ID NO: 473 | IDPENGEA SEQ ID NO: 474 | AAGAVGADSGSWFDP SEQ ID NO: 475 | KLGDKY SEQ ID NO: 476 | END SEQ ID NO: 352 | QAWETTTTFV SEQ ID NO: 201 |
| 105 | GGAFSSYA SEQ ID NO: 477 | ITPVFGET SEQ ID NO: 478 | TRDRRVVPMATDNWLDP SEQ ID NO: 479 | QTIHTY SEQ ID NO: 480 | GAS SEQ ID NO: 358 | QQSYSTPRT SEQ ID NO: 207 |
| 106 | GNSFSNHD SEQ ID NO: 481 | MSHEGDKT SEQ ID NO: 482 | LTGSKHRLRDYFLYNEYGPNYEEWGD YLATLDV SEQ ID NO: 483 | HSLQHSTGAN Y SEQ ID NO: 484 | LAT SEQ ID NO: 364 | MQGLHSPWT SEQ ID NO: 213 |
| 107 | GNTFSKYD SEQ ID NO: 485 | ISHERDKT SEQ ID NO: 486 | TRGSKHRLRDYVLYDDYGLINYQEWN DYLEFLDV SEQ ID NO: 487 | QSLRHSNGAN Y SEQ ID NO: 488 | LGS SEQ ID NO: 370 | MQGLNRPWT SEQ ID NO: 219 |
| 108 | GNTFSKYD SEQ ID NO: 485 | MSHEGDKT SEQ ID NO: 482 | TRGSKHRLRDYVLYDDYGLINYQEWN DYLEFLDV SEQ ID NO: 487 | QSLRHSNGAN Y SEQ ID NO: 488 | LGS SEQ ID NO: 370 | MQGLNRPWT SEQ ID NO: 219 |
| 109 | GNTFRKYD SEQ ID NO: 489 | MSHEGDKT SEQ ID NO: 482 | TGGSKHRLRDYVLYDDYGLINQQEWN DYLEFLDV SEQ ID NO: 490 | QSLRHSNGAN Y SEQ ID NO: 488 | LGS SEQ ID NO: 370 | MQGLNRPWT SEQ ID NO: 219 |
| 110 | QFRFDGYG SEQ ID NO: 958 | ISHDGIKK SEQ ID NO: 959 | AKDLREDECEEWWSDYYDFGKQLPCA KSRGGLVGIADN SEQ ID NO: 960 | TSNIGNNF SEQ ID NO: 961 | ETD SEQ ID NO: 942 | ATWAASLSSARV SEQ ID NO: 919 |
| 111 | DFPFSKYP SEQ ID NO: 491 | ISGDAWHV SEQ ID NO: 492 | ARMFQESGPPRLDRWSGRNYYYYSGM DV SEQ ID NO: 493 | ESLRQSNGKT S SEQ ID NO: 494 | EVS SEQ ID NO: 378 | MQSKDFPLT SEQ ID NO: 228 |
| 112 | GVNTFGLYA SEQ ID NO: 495 | IWRWKS SEQ ID NO: 496 | TTTSTYDKWSGLHHDGVMAFSS SEQ ID NO: 497 | QSITGNW SEQ ID NO: 498 | RGA SEQ ID NO: 384 | QQYDTYPGT SEQ ID NO: 234 |
| 113 | GDSVSNDNYY SEQ ID NO: 962 | IYYSGTT SEQ ID NO: 963 | VRMPSHGFWSTSFSYWYFDL SEQ ID NO: 964 | QSVTKY SEQ ID NO: 965 | GTY SEQ ID NO: 948 | QQAHSTPWT SEQ ID NO: 925 |

TABLE D4

CDRs (Honegger) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 114 | VSGASISDSY SEQ ID NO: 499 | VHKSGDTNYSPSLKSR SEQ ID NO: 500 | TLHGRRIYGIVAF NEWFTYFYMD SEQ ID NO: 501 | EKSLGSRA SEQ ID NO: 238 | NNQDRPSGIPER SEQ ID NO: 502 | WDSRVPTKW SEQ ID NO: 240 |
| 115 | VSGASISDSY SEQ ID NO: 499 | VHKSGDTNYNPSLKSR SEQ ID NO: 503 | TLHGRRIYGIVAF NEWFTYFYMD SEQ ID NO: 501 | EKSLGSRA SEQ ID NO: 238 | NNQDRPSGIPER SEQ ID NO: 502 | WDSRVPTKW SEQ ID NO: 240 |
| 116 | VSGDSMNNYY SEQ ID NO: 505 | ISDRESATYNPSLNSR SEQ ID NO: 506 | ARRGQRIYGVVSF GEFFYYYSMD SEQ ID NO: 507 | RQALGSRA SEQ ID NO: 244 | NNQDRPSGIPER SEQ ID NO: 502 | WDSRSGFSW SEQ ID NO: 245 |
| 117 | VSGGSISNYY SEQ ID NO: 508 | ISDRETTTYNPSLNSR SEQ ID NO: 509 | ARRGQRIYGVVSF GEFFYYYYMD SEQ ID NO: 510 | RQALGSRA SEQ ID NO: 244 | NNQDRPSGIPER SEQ ID NO: 502 | WDSRSGFSW SEQ ID NO: 245 |
| 118 | VSNGSVSGRF SEQ ID NO: 511 | FSDTDRSEYNPSLRSR SEQ ID NO: 512 | AQQGKRIYGIVSF GELFYYYYMD SEQ ID NO: 513 | ERSRGSRA SEQ ID NO: 251 | NNQDRPAGVSER SEQ ID NO: 514 | WDSRSPISW SEQ ID NO: 252 |
| 119 | VSNGSVSGRF SEQ ID NO: 511 | FSDTDRSEYNPSLRSR SEQ ID NO: 512 | AQQGKRIYGIVSF GEFFYYYYMD SEQ ID NO: 515 | ERSRGSRA SEQ ID NO: 251 | NNQDRPAGVSER SEQ ID NO: 514 | WDSRSPISW SEQ ID NO: 252 |
| 120 | VSGTLVRDNY SEQ ID NO: 516 | VHDSGDTNYNPSLKSR SEQ ID NO: 517 | TKHGRRIYGVVAF KEWFTYFYMD SEQ ID NO: 518 | EESLGSRS SEQ ID NO: 257 | NNNDRPSGIPDR SEQ ID NO: 519 | WDSRRPTNW SEQ ID NO: 259 |
| 121 | VSGASINDAY SEQ ID NO: 520 | VHHSGDTNYNPSLKRR SEQ ID NO: 521 | ALHGKRIYGIVAL GELFTYFYMD SEQ ID NO: 522 | KESIGSRA SEQ ID NO: 263 | NNQDRPAGVPER SEQ ID NO: 523 | YDARGGTNW SEQ ID NO: 264 |
| 122 | VSGESTGACTYF SEQ ID NO: 524 | LSHCQSFWGSGWTFHNP SLKSR SEQ ID NO: 525 | FDGEVLVYNHWPK PAWVD SEQ ID NO: 526 | GTATNF SEQ ID NO: 268 | GVDKRPPGVPDR SEQ ID NO: 527 | LVGNWDV SEQ ID NO: 270 |
| 123 | VSGDSTAACDYF SEQ ID NO: 528 | LSHCAGYYNTGWTYHNP SLKSR SEQ ID NO: 529 | FDGEVLVYHDWPK PAWVD SEQ ID NO: 530 | GTSNRF SEQ ID NO: 274 | GVNKRPSGVPDR SEQ ID NO: 531 | LVGNWDV SEQ ID NO: 270 |
| 124 | VSGDSTAACDYF SEQ ID NO: 528 | LSHCAGYYNSGWTYHNP SLKSR SEQ ID NO: 532 | FGGDVLVYHDWPK PAWVD SEQ ID NO: 533 | GNINNF SEQ ID NO: 278 | GVNKRPSGVPDR SEQ ID NO: 531 | LAGNWDV SEQ ID NO: 279 |
| 125 | VSGDSTAACNSF SEQ ID NO: 534 | LSHCASYWNRGWTYHNP SLKSR SEQ ID NO: 535 | FGGEVLRYTDWPK PAWVD SEQ ID NO: 536 | GTSNNF SEQ ID NO: 283 | DVNKRPSGVPDR SEQ ID NO: 537 | LVGNWDV SEQ ID NO: 270 |
| 126 | VSGDSTAGCDYF SEQ ID NO: 1090 | LSHCAGYYNTGWTYHNP SLKSR SEQ ID NO: 529 | FDGEVLVYNDWPK PAWVD SEQ ID NO: 538 | GTSNNF SEQ ID NO: 283 | GVNKRPSGVPDR SEQ ID NO: 531 | LVGNWDV SEQ ID NO: 270 |
| 127 | VSGESINTGHYY SEQ ID NO: 539 | IHYTTAVLHNPSLKSR SEQ ID NO: 540 | SGGDILYYYEWQK PHWFS SEQ ID NO: 541 | GTSSDIGGWNF SEQ ID NO: 290 | EVNKRPSGVPGR SEQ ID NO: 542 | LFGRWDV SEQ ID NO: 292 |
| 128 | VSGGSMRGTDWGE NDFH SEQ ID NO: 543 | IHWRGRTTHYKTSFRSR SEQ ID NO: 544 | HKYHDIFRVVPVA GWFD SEQ ID NO: 545 | ASQNVKNN SEQ ID NO: 546 | DASSRAGGIPDR SEQ ID NO: 547 | YEEWPR SEQ ID NO: 298 |
| 129 | ASGGSIRGGEWGD SDYH SEQ ID NO: 548 | IHWRGTTHYNAPFRGR SEQ ID NO: 549 | HKYHDIVMVVPIA GWFD SEQ ID NO: 550 | ASQSVKNN SEQ ID NO: 1091 | DTSSRASGIPAR SEQ ID NO: 551 | YEEWPR SEQ ID NO: 298 |
| 130 | VSGDSIRGGEWGD KDYH SEQ ID NO: 552 | IHWRGTTHYKESLRRR SEQ ID NO: 553 | HRHHDVFMLVPIA GWFD SEQ ID NO: 554 | ASQNINKN SEQ ID NO: 555 | ETYSKIAAFPAR SEQ ID NO: 556 | YEEWPR SEQ ID NO: 298 |
| 131 | VSQDSRPSDHS SEQ ID NO: 557 | IHYNGATTYNPSLRSR SEQ ID NO: 558 | NAIRIYGVVALGE WFHYGMD SEQ ID NO: 559 | GAPLTSRF SEQ ID NO: 311 | RSSQRSSGWSGR SEQ ID NO: 560 | SDTSDSYK SEQ ID NO: 313 |
| 132 | ASGYNIRDYF SEQ ID NO: 561 | INPKTGQPNNPRQFQGR SEQ ID NO: 562 | QRSDYWDFD SEQ ID NO: 563 | ANGY SEQ ID NO: 564 | DGSKLERGVPSRF SEQ ID NO: 565 | YE SEQ ID NO: 327 |

TABLE D4-continued

CDRs (Honegger) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 133 | ASGYKISDHF SEQ ID NO: 566 | INPKTGQPNNPRQFQGR SEQ ID NO: 562 | QRSDFWDFD SEQ ID NO: 1092 | ANGY SEQ ID NO: 564 | DGSKLERGVPAR SEQ ID NO: 567 | YE SEQ ID NO: 327 |
| 134 | ASGYEFINCP SEQ ID NO: 568 | MKPRGGAVSYARQLQGR SEQ ID NO: 569 | GKYCTARDYYNWD FE SEQ ID NO: 570 | TSQYGS SEQ ID NO: 571 | SGSTRAAGIPDR SEQ ID NO: 572 | YE SEQ ID NO: 327 |
| 135 | ASGYEFINCP SEQ ID NO: 568 | MKPRHGAVSYARQLQGR SEQ ID NO: 573 | GKYCTARDYYNWD FE SEQ ID NO: 570 | TSQYGS SEQ ID NO: 571 | SGSTRAAGIPDR SEQ ID NO: 572 | YE SEQ ID NO: 327 |
| 136 | ASGYEFIDCT SEQ ID NO: 574 | LKPRGGAVNYARPLQGR SEQ ID NO: 575 | GKNCDYNWDFE SEQ ID NO: 576 | TSQYGS SEQ ID NO: 571 | SGSTRAAGIPDR SEQ ID NO: 572 | YE SEQ ID NO: 327 |
| 137 | TSGYTFTAHI SEQ ID NO: 577 | IKPQYGAVNFGGGFRDR SEQ ID NO: 578 | DRSYGDSSWALD SEQ ID NO: 579 | TSQGVGSD SEQ ID NO: 580 | HTSSVEDGVPSR SEQ ID NO: 581 | LQ SEQ ID NO: 336 |
| 138 | ADDDPYTDDDTFT KYW SEQ ID NO: 966 | ISPHFARPIYSYKFRDR SEQ ID NO: 967 | DPFGDRAPHYNYH MD SEQ ID NO: 968 | ASQGLDSSH SEQ ID NO: 969 | GTSNRARGTPDR SEQ ID NO: 970 | YGGTPI SEQ ID NO: 931 |
| 139 | TSEDIFERTEL SEQ ID NO: 971 | VKTVTGAVNFGSPDFRQ SEQ ID NO: 972 | QKFYTGGQGWYFD SEQ ID NO: 973 | AASYGH SEQ ID NO: 974 | ATSKRASGIPDR SEQ ID NO: 975 | LE SEQ ID NO: 937 |
| 140 | ASGFDFSRQG SEQ ID NO: 582 | IKYDGSEKYHADSVWGR SEQ ID NO: 583 | EAGGPDYRNGYNY YDFYDGYYNYHYM D SEQ ID NO: 584 | GTSNDVGGYES SEQ ID NO: 340 | DVSKRPSGVSNR SEQ ID NO: 585 | LTSTRRR SEQ ID NO: 342 |
| 141 | ASGFTFHKYG SEQ ID NO: 586 | ISDDGMRKYHSDSMWGR SEQ ID NO: 587 | EAGGPIWHDDVKY YDFNDGYYNYHYM D SEQ ID NO: 588 | GTSSDVGGFDS SEQ ID NO: 346 | DVSHRPSGISNR SEQ ID NO: 589 | LTDRSHR SEQ ID NO: 347 |
| 142 | VSGYSFIDYY SEQ ID NO: 590 | IDPENGEARYAEKFQGR SEQ ID NO: 591 | GAVGADSGSWFD SEQ ID NO: 592 | GSKLGDKY SEQ ID NO: 351 | ENDRRPSGIPER SEQ ID NO: 593 | WETTTTTF SEQ ID NO: 353 |
| 143 | ASGGAFSSYA SEQ ID NO: 594 | ITPVFGETKYAPRFQGR SEQ ID NO: 595 | DRRVVPMATDNWL D SEQ ID NO: 596 | ASQTIHTY SEQ ID NO: 597 | GASTLQSGVPSR SEQ ID NO: 598 | SYSTPR SEQ ID NO: 359 |
| 144 | ASGNSFSNHD SEQ ID NO: 599 | MSHEGDKTGLAQKFQGR SEQ ID NO: 600 | GSKHRLRDYFLYN EYGPNYEEWGDYL ATLD SEQ ID NO: 601 | CSHSLQHSTGA NY SEQ ID NO: 602 | LATHRASGVPDR SEQ ID NO: 603 | GLHSPW SEQ ID NO: 365 |
| 145 | ASGNTFSKYD SEQ ID NO: 604 | ISHERDKTESAQRFKGR SEQ ID NO: 605 | GSKHRLRDYVLYD DYGLINYQEWNDY LEFLD SEQ ID NO: 606 | STQSLRHSNGA NY SEQ ID NO: 607 | LGSQRASGVPDR SEQ ID NO: 608 | GLNRPW SEQ ID NO: 371 |
| 146 | ASGNTFSKYD SEQ ID NO: 604 | MSHEGDKTESAQRFKGR SEQ ID NO: 609 | GSKHRLRDYVLYD DYGLINYQEWNDY LEFLD SEQ ID NO: 606 | STQSLRHSNGA NY SEQ ID NO: 607 | LGSQRASGVPDR SEQ ID NO: 608 | GLNRPW SEQ ID NO: 371 |
| 147 | ASGNTFRKYD SEQ ID NO: 610 | MSHEGDKTESAQRFKGR SEQ ID NO: 609 | GSKHRLRDYVLYD DYGLINQQEWNDY LEFLD SEQ ID NO: 611 | STQSLRHSNGA NY SEQ ID NO: 607 | LGSQRASGVPDR SEQ ID NO: 608 | GLNRPW SEQ ID NO: 371 |
| 148 | ASQFRFDGYG SEQ ID NO: 976 | ISHDGIKKYHAEKVWGR SEQ ID NO: 977 | DLREDECEEWWSD YYDFGKQLPCAKS RGGLVGIAD SEQ ID NO: 978 | GNTSNIGNNF SEQ ID NO: 941 | ETDKRPSGIPDR SEQ ID NO: 979 | WAASLSSAR SEQ ID NO: 943 |

TABLE D4-continued

CDRs (Honegger) for illustrative anti-HIV antigen binding arm

| Ab Name | VH - CDR1 | VH - CDR2 | VH - CDR3 | VL - CDR1 | VL - CDR2 | VL - CDR3 |
|---|---|---|---|---|---|---|
| 149 | VSDFPFSKYP SEQ ID NO: 612 | ISGDAWHVVYSNSVQGR SEQ ID NO: 613 | MFQESGPPRLDRW SGRNYYYYSGMD SEQ ID NO: 614 | SSESLRQSNGK IS SEQ ID NO: 615 | EVSNRFSGVSDR SEQ ID NO: 616 | SKDFPL SEQ ID NO: 379 |
| 150 | AYGVNTFGLYA SEQ ID NO: 617 | IWRWKSSASHHFRGR SEQ ID NO: 618 | TSTYDKWSGLHHD GVMAFS SEQ ID NO: 619 | ASQSITGNW SEQ ID NO: 620 | RGAALLGGVPSR SEQ ID NO: 621 | YDTYPG SEQ ID NO: 385 |
| 151 | VSGDSVSNDNYY SEQ ID NO: 980 | IYYSGTTYYNPSLRNR SEQ ID NO: 981 | MPSHGFWSTSFSY WYFD SEQ ID NO: 982 | ASQSVTKY SEQ ID NO: 983 | GTYTLLSGVSPR SEQ ID NO: 984 | AHSTPW SEQ ID NO: 949 |

TABLE E

VH/VL for illustrative anti-HIV binding arm

| Ab Name | SEQ ID NO | VH | SEQ ID NO | VL |
|---|---|---|---|---|
| 320 | 622 | QMQLQESGPGLVKPSETLSLTCSVSGASISDSYWSWIRRS PGKGLEWIGYVHKSGDTNYSPSLKSRVNLSLDTSKNQVSL SLVAATAADSGKYYCARTLHGRRIYGIVAFNEWFTYFYMD VWGNGTQVTVSS | 623 | SDISVAPGETARISCGEKSLGSRAVQWYQHRA GQAPSLIIYNNQDRPSGIPERFSGSPDSPFGT TATLTITSVEAGDEADYYCHIWDSRVPTKWVF GGGTTLTVL |
| 321 | 624 | QMQLQESGPGLVKPSETLSLTCSVSGASISDSYWSWIRRS PGKGLEWIGYVHKSGDTNYNPSLKSRVHLSLDTSKNQVSL SLTGVTAADSGKYYCARTLHGRRIYGIVAFNEWFTYFYMD VWGTGTQVTVSS | 625 | SDISVAPGETARISCGEKSLGSRAVQWYQHRA GQAPSLIIYNNQDRPSGIPERFSGSPDSRPGT TATLTITSVEAGDEADYYCHIWDSRVPTKWVF GGGTTLTVL |
| 322 | 624 | QMQLQESGPGLVKPSETLSLTCSVSGASISDSYWSWIRRS PGKGLEWIGYVHKSGDTNYNPSLKSRVHLSLDTSKNQVSL SLTGVTAADSGKYYCARTLHGRRIYGIVAFNEWFTYFYMD VWGTGTQVTVSS | 626 | SDISVAPGETARISCGEKSLGSRAVQWYQHRA GQAPSLIIYNNQDRPSGIPERFSGSPDFRPGT TATLTITSVEAGDEADYYCHIWDSRVPTKWVF GGGTTLTVL |
| 323 | 627 | QMQLQESGPGLVKPSETLSLTCSVSGASISDSYWSWIRQP PGKGLEWIGYVHKSGDTNYSPSLKSRVNLSLDTSKNQVSL SLSAATAADSGVYYCARTLHGRRIYGIVAFNEWFTYFYMD VWGNGTQVTVSS | 628 | SDISVAPGETARISCGEKSLGSRAVQWYQQRA GQAPSLIIYNNQDRPSGIPERFSGSPDSGFGT TATLTITSVEAGDEADYYCHIWDSRVPTKWVF GGGTTLTVL |
| 324 | 629 | QVQLQESGPGLVKPSETLSVTCSVSGDSMNNYYWTWIRQS PGKGLEWIGYISDRESATYNPSLNSRVVISRDTSKNQLSL KLNSVTPADTAVYYCATARRGQRIYGVVSFGEFFYYYSMD VWGKGTTVTVSS | 630 | SYVRPLSVALGETARISCGRQALGSRAVQWYQ HRPGQAPILLIYNNQDRPSGIPERFSGTPDIN FGTRATLTISGVEAGDEADYYCHMWDSRSGFS WSFGGATRLTVL |
| 325 | 631 | QVQLQESGPGLVKPSETLSVTCSVSGDSMNNYYWTWIRQS PGKGLEWIGYISDRESATYNPSLNSRVTISRDTSKNQFSL KLNSVTPADTAVYYCARARRGQRIYGVVSFGEFFYYYSMD VWGKGTTVTVSS | 632 | SPVRPLSVALGETARISCGRQALGSRAVQWYQ HRPGQAPILLIYNNQDRPSGIPERFSGTPDIN FGTRATLTISGVEAGDEADYYCHMWDSRSGFS WSFGGATRLTVL |
| 326 | 633 | QVQLQESGPGLVRPSETLSVTCIVSGGSISNYYWTWIRQS PGKGLEWIGYISDRETTTYNPSLNSRAVISRDTSKNQLSL QLRSVTTADTAIYFCATARRGQRIYGVVSFGEFFYYYMD VWGKGTAVTVSS | 634 | SVTSYVSPLSVALGETARISCGRQALGSRAVQ WYQHKPGQAPILLIYNNQDRPSGIPERFSGTP DINFGTTATLTISGVEVGDEADYYCHMWDSRS GFSWSFGGATRLTVL |
| 327 | 635 | QVHLQESGPGLVTPSETLSLTCTVSNGSVSGRFWSWIRQS PGRGLEWIGYFSDTDRSEYNPSLRSRLTLSVDRSKNQLSL KLKSVTAADSATYYCARAQQGKRIYGIVSFGELFYYYYMD AWGKGTPVTVSS | 636 | SLNPLSLAPGATAKIPCGERSRGSRAVQWYQQ KPGQAPTLIIYNNQDRPAGVSERFSGNPDVAI GVTATLTISRVEVGDEGDYYCHYWDSRSPISW IFAGGTQLTVL |
| 328 | 637 | QVHLQESGPGLVTPSETLSLTCTVSNGSVSGRFWSWIRQS PGRGLEWIGYFSDTDRSEYNPSLRSRLTLSVDRSKNQLSL RLKSVTAADSATYYCARAQQGKRIYGIVSFGEFFYYYYMD AWGKGTPVTVSS | 638 | SLNPLSLAPGATAKIPCGERSRGSRAVQWYQQ KPGQAPTLIIYNNQDRPAGVSERFSGNPDVAI GVTATLTISRVEVGDEGDYYCHYWDSRSPISW IFGGGTQLTVL |
| 329 | 639 | QVHLQESGPGLVKPSETLSLTCNVSGTLVRDNYWSWIRQP LGKQPEWIGYVHDSGDTNYNPSLKSRVHLSLDKSKNLVSL RLTGVTAADSAIYYCATTKHGRRIYGVVAFKEWFTYFYMD VWGKGTSVTVSS | 640 | TFVSVAPGQTARITCGEESLGSRSVIWYQQRP GQAPSLIIYNNNDRPSGIPDRFSGSPGSTFGT TATLTITSVEAGDEADYYCHIWDSRRPTNWVF GEGTTLIVL |

TABLE E-continued

VH/VL for illustrative anti-HIV binding arm

| Ab Name | SEQ ID NO | VH | SEQ ID NO | VL |
|---|---|---|---|---|
| 330 | 641 | QLHLQESGPGLVKPPETLSLTCSVSGASINDAYWSWIRQS PGKRPEWVGYVHHSGDTNYNPSLKRRVTFSLDTAKNEVSL KLVDLTAADSATYFCARALHGKRIYGIVALGELFTYFYMD VWGKGTAVTVSS | 642 | SSMSVSPGETAKISCGKESIGSRAVQWYQQKP GQPPSLIIYNNQDRPAGVPERFSASPDFRPGT TATLTITNVDAEDEADYYCHIYDARGGTNWVF DRGTTLTVL |
| 331 | 643 | QSQLQESGPRLVEASETLSLTCNVSGESTGACTYFWGWVR QAPGKGLEWIGSLSHCQSFWGSGWTFHNPSLKSRLTISLD TPKNQVFLKLTSLTAADTATYYCARFDGEVLVYNHWPKPA WVDLWGRGIPVTVSS | 644 | QSALTQPPSASGSPGQSITISCNGTATNFVSW YQQFPDKAPKLIIFGVDKRPPGVPDRFSGSRS GTTASLTVSRLQTDDEAVYYCGSLVGNWDVIF GGGTTLTVL |
| 332 | 645 | QPQLQESGPGLVEASETLSLTCTVSGDSTAACDYFWGWVR QPPGKGLEWIGGLSHCAGYYNTGWTYHNPSLKSRLTISLD TPKNQVFLKLNSVTAADTAIYYCARFDGEVLVYHDWPKPA WVDLWGRGTLVTVSS | 646 | QSALTQPPSASGSPGQSISISCTGTSNRFVSW YQQHPGKAPKLVIYGVNKRPSGVPDRFSGSKS GNTASLTVSGLQTDDEAVYYCSSLVGNWDVIF GGGTKLTVL |
| 333 | 647 | QPQLQESGPGLVEASETLSLTCTVSGDSTAACDYFWGWVR QPPGKGLEWIGSLSHCAGYYNSGWTYHNPSLKSRLTISLD TPKNQVFLKLNSVTAADTAIYYCARFGGDVLVYHDWPKPA WVDLWGRGVLVTVSS | 648 | QSALTQPPSASGSPGQSITISCTGNINNFVSW YQQHPGKAPKLVIYGVNKRPSGVPDRFSGSKS GNAASLTVSGLQTDDEAVYYCGSLAGNWDVVF GGGTKLTVL |
| 334 | 649 | QPQLQESGPTLVEASETLSLTCAVSGDSTAACNSFWGWVR QPPGKGLEWVGSLSHCASYWNRGWTYHNPSLKSRLTLALD TPKNLVFLKLNSVTAADTATYYCARFGGEVLRYTDWPKPA WVDLWGRGTLVTVSS | 650 | QSALTQPPSASGSPGQSITISCTGTSNNFVSW YQQHAGKAPKLVIYDVNKRPSGVPDRFSGSKS GNTASLTVSGLQTDDEAVYYCGSLVGNWDVIF GGGTKLTVL |
| 335 | 651 | QPQLQESGPGLVEASETLSLTCTVSGDSTAGCDYFWGWVR QPPGKGLEWIGGLSHCAGYYNTGWTYHNPSLKSRLTISLD TPKNQVFLKLNSVTAADTAIYYCARFDGEVLVYNDWPKPA WVDLWGRGTLVTVSS | 652 | QSALTQPPSASGSPGQSITISCTGTSNNFVSW YQQHPAKAPKLVIYGVNKRPSGVPDRFSGSKS GNTASLTVSGLQTDDEAVYYCGSLVGNWDVIF GGGTKLTVL |
| 336 | 653 | QVQLQESGPGLVKPAETLSLTCSVSGESINTGHYYWGWVR QVPGKGLEWIGHIHYTTAVLHNPSLKSRLTIKIYTLRNQI TLRLSNVTAADTAVYHCVRSGGDILYYYEWQKPHWFSPWG PGIHVTVSS | 654 | QSALTQPPSASGSLGQSVTISCNGTSSDIGGW NFVSWYQQFPGRAPRLIIFEVNKRPSGVPGRF SGSKSGNSASLTVSGLQSDDEGQYFCSSLFGR WDVVFGGGTKLTVL |
| 337 | 655 | QLQLQESGPGLVKPSETLSLTCTVSGGSMRGTDWGENDFH YGWIRQSSAKGLEWIGSIHWRGRTTHYKTSFRSRATLSID TSNNRFSLTFSFVTAADTAVYYCARHKYHDIFRVVPVAGW FDPWGQGLLVTVSS | 656 | EIVMTQSPPTLSVSPGETATLSCRASQNVKNN LAWYQLKPGQAPRLLIFDASSRAGGIPDRFSG SGYGTDFTLTVNSVQSEDFGDYFCQQYEEWPR TFGQGTKVDIK |
| 338 | 657 | EVHLEESGPGLVRPSETLSLTCTASGGSIRGGEWGDSDYH WGWVRHSPEKGLEWIGSIHWRGTTHYNAPFRGRGRLSIDL SRNQFSLRLTSVTAEDTAVYYCVKHKYHDIVMVVPIAGWF DPWGQGLQVTVSS | 658 | EIMMTQSPAILSVSPGDRATLSCRASQSVKNN LAWYQKRPGQAPRLLIFDTSSRASGIPARFSG GGSGTEFTLTVNSMQSEDFATYYCQQYEEWPR TFGQGTKVEIK |
| 339 | 659 | QLQMQESGPGLVKPSETLSLSCTVSGDSIRGGEWGDKDYH WGWVRHSAGKGLEWIGSIHWRGTTHYKESLRRRVSMSIDT SRNWFSLRLASVTAADTAVYFCARHRHHDVFMLVPIAGWF DVWGPGVQVTVSS | 660 | EIVMTQSPDTLSVSPGETVTLSCRASQNINKN LAWYQYKPGQSPRLVIFETYSKIAAFPARFVA SGSSGTEFTLTINNMQSEDVAVYYCQQYEEWPR TFGQGTKVDIK |
| 340 | 661 | QVQLRESGPGLVKPSETLSLSCTVSQDSRPSDHSWTWVRQ SPGKALEWIGDIHYNGATTYNPSLRSRVRIELDQSIPRFS LKMTSMTAADTGMYYCARNAIRIYGVVALGEWFHYGMDVW GQGTAVTVSS | 662 | WASSELTQPPSVSVSPGQTARITCSGAPLTSR FTYWYRQKPGQAPVLIISRSSQRSSGWSGRFS ASWSGTTVTLTIRGVQADDEADYYCQSSDTSD SYKMFGGGTKLTVL |
| 341 | 663 | QVQLLQSGAAVTKPGASVRVSCEASGYNIRDYFIHWWRQA PGQGLQWVGWINPKTGQPNNPRQFQGRVSLTRHASWDFDT FSFYMDLKALRSDDTAVYFCARQRSDYWDFDVWGSGTQVT VSS | 664 | DIQMTQSPSSLSASVGDTVTITCQANGYLNWY QQRRGKAPKLLIYDGSKLERGVPSRFSGRRWG QEYNLTINNLQPEDIATYFCQVYEFVVPGTRL DLK |
| 342 | 665 | QVQLLQSGAAVTKPGASVRVSCEASGYNIRDYFIHWWRQA PGQGLQWVGWINPKTGQPNNPRQFQGRVSLTRHASFDFDT FSFYMDLKALRSDDTAVYFCARQRSDYWDFDVWGSGTQVT VSS | 666 | DIQMTQSPSSLSASVGDTATITCQANGYLNWY QQRRGKAPKLLIYDGSKLERGVPSRFSGRRWG QEYNLTINNLQPEDIATYFCQVYEFVVPGTRL DLK |
| 343 | 667 | QVHLSQSGAAVTKPGASVRVSCEASGYKISDHFIHWWRQA PGQGLQWVGWINPKTGQPNNPRQFQGRVSLTRQASWDFDT YSFYMDLKAVRSDDTAIYFCARQRSDFWDFDVWGSGTQVT VSS | 668 | DIQMTQSPSSLSARVGDTVTITCQANGYLNWY QQRRGKAPKLLIYDGSKLERGVPARFSGRRWG QEYNLTINNLQPEDVATYFCQVYEFIVPGTRL DLK |
| 344 | 669 | QVRLSQSGGQMKKPGDSMRISCRASGYEFINCPINWIRLA PGKRPEWMGWMKPRGGAVSYARQLQGRVTMTRDMYSETAF LELRSLTSDDTAVYFCTRGKYCTARDYYNWDFEHWGQGTP VTVSS | 670 | EIVLTQSPGTLSLSPGETAIISCRTSQYGSLA WYQQRPGQAPRLVIYSGSTRAAGIPDRFSGSR WGPDYNLTISNLESGDFGVYYCQQYEFFGQGT KVQVDIK |

TABLE E-continued

VH/VL for illustrative anti-HIV binding arm

| Ab Name | SEQ ID NO | VH | SEQ ID NO | VL |
|---|---|---|---|---|
| 345 | 671 | QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS | 672 | SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |
| 346 | 673 | QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS | 670 | EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK |
| 347 | 674 | RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSA | 675 | YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIK |
| 348 | 985 | QGRLFQSGAEVKRPGASVRISCRADDDPYTDDDTFTKYWTHWIRQAPGQRPEWLGVISPHFARPIYSYKFRDRLTLTRDSSLTAVYLELKGLQPDDSGIYFCARDPFGDRAPHYNYHMDVWGGGTAVIVSS | 986 | EVVLTQSPAILSVSPGDRVILSCRASQGLDSSHLAWYRFKRGQIPTLVIFGTSNRARGTPDRFSGSGSGADFTLTISRVEPEDFATYYCQRYGGTPITFGGGTTLDKKRTVA |
| 349 | 987 | QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCARQKFYTGGQWYFDLWGRGTLIVVSS | 988 | EIVLTQSPGTLSLSPGETASLSCTAASYGHMTWYQKKPGQPPKLLIFATSKRASGIPDRFSGSQFGKQYTLTITRMEPEDFARYYCQQLEFFGQGTRLEIRRTVA |
| 350 | 676 | CQRLVESGGGVVQPGSSLRLSCAASGFDFSRQGMHWVRQAPGQGLEWVAPIKYDGSEKYHADSVWGRLSISRDNSKDTLYLQMNSLRVEDTATYFCVREAGGPDYRNGYNYYDFYDGYYNYHYMDVWGKGTTVTVSS | 677 | QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL |
| 351 | 678 | QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS | 679 | QSALTQPASVSGSPGQTITISCNGTSSDVGGFDSVSWYQQSPGKAPKVMVPDVSHRPSGISNRFSGSKSGNTASLTISGLHIEDEGDYFCSSLTDRSHRIFGGGTKVTVL |
| 352 | 680 | DGHLVQSGVEVKKTGATVKISCKVSGYSFIDYYLHWVRAPGKGLEWVGLIDPENGEARYAEKFQGRVTIIADTSIDTGYMEMRSLKSEDTAVYFCAAGAVGADSGSWFDPWGQGTLVTVSSASTKGPSVFPLAPSS | 681 | SYELTQPPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVL |
| 353 | 682 | QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSSASTKGPSVFPLAPSS | 683 | DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIK |
| 354 | 684 | QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSS | 685 | EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIK |
| 355 | 686 | QVQLVQSGPEVKKPGSSVKVSCKASGNIFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS | 687 | DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK |
| 356 | 688 | QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS | 689 | DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK |
| 357 | 690 | QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS | 691 | DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK |
| 358 | 989 | QVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSS | 990 | QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVL |
| 359 | 692 | RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYSGMDVWGQGTTVTVSS | 693 | DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDL |

TABLE E-continued

VH/VL for illustrative anti-HIV binding arm

| Ab Name | SEQ ID NO | VH | SEQ ID NO | VL |
|---|---|---|---|---|
| 360 | 694 | QIHLVQSGTEVKKPGSSVTVSCKAYGVNTFGLYAVNWVRQ APGQSLEYIGQIWRWKSSASHHFRGRVLISAVDLTGSSPP ISSLEIKNLTSDDTAVYFCTTTSTYDKWSGLHHDGVMAFS SWGQGTLISVSA | 695 | DIQMTQSPSTLSASIGDTVRISCRASQSITGN WVAWYQQRPGKAPRLLIYRGAALLGGVPSRFS GSAAGTDFTLTIGNLQAEDFGTFYCQQYDTYP GTFGQGTKVEVK |
| 361 | 991 | EVQLVESGPGLVQPWGTLSLTCRVSGDSVSNDNYYWAWIR QTPGRELQVIGTIYYSGTTYYNPSLRNRVTISLDKSVNVV SLRLGSVSAADTAQYYCVRMPSHGFWSTSFSYWYFDLWGR GHFVAVSW | 992 | DIQMTQSPSSLSASVGDKVTITCRASQSVTKY LNWYQFKTGQAPRILIYGTYTLLSGVSPRFSG AGSGSLYTLTITNIQPEDFATYYCQQAHSTPW TFGQGTHVAANRTVA |

4. Fc Domains or Fc Regions

In certain embodiments, the Fc region or Fc domain of one or both of the CD3-targeting heavy chain and the HIV antigen-targeting heavy chain is from a human IgG. In one embodiment, the Fc region or Fc domain of the multi-specific antigen binding molecule is an IgG1, IgG2, IgG4, or chimeras thereof. In some embodiments, the antibody has a chimeric heavy chain constant region (e.g., having the CH1, hinge, and CH2 regions of IgG4 and CH3 region of IgG1). In some embodiments, the Fc region is from a human IgG1 or IgG4. In some embodiments, the Fc region is from a human IgG1. In some embodiments, the Fc region is from a human IgG4.

In certain embodiments the Fc region or Fc domain of one or both of the CD3-targeting heavy chain and the HIV antigen-targeting heavy chain, is directly linked to, or linked via an intervening amino acid sequence (e.g., a G-S linker), to a human IgG1 (e.g., a wild-type or mutant IgG1m3 sequence), IgG2, IgG3 or IgG4 with 1 to 10 (e.g., 1, 2, 3, 4, 5, 6, 7, 8, 9, 10) amino acid substitutions. In some embodiments, the Fc modifications can promote one or more of increased serum half-life or decreased antibody effector function of the molecule. In other embodiments, certain of these modifications, decrease antibody effector function and increase half-life of the antibody. In some embodiments, the Fc region or Fc domain of one or both of the CD3-targeting heavy chain and the HIV antigen-targeting heavy chain comprise two or more, three or more, four or more, five or more, six or more, six or fewer, five or fewer, four or fewer, three or fewer, two or fewer, or one modified Fc amino acid residue(s). As appropriate, the Fc region or Fc domain of one or both of the CD3-targeting heavy chain and the HIV antigen-targeting heavy chain can be the same or different. In some embodiments, the Fc region or Fc domain of one or both of the CD3-targeting heavy chain and the HIV antigen-targeting heavy chain independently can comprise two or more, three or more, four or more, five or more, six or more, six or fewer, five or fewer, four or fewer, three or fewer, two or fewer, or one modified Fc amino acid residue(s). Illustrative amino acid substitutions are described below.

IgG1 Isotype Fc

In one embodiment, the Fc region comprises or is derived from a human IgG1. In some embodiments, the antibody has a chimeric heavy chain constant region (e.g., having the CH1, hinge, CH2 regions of IgG4 and CH3 region of IgG1).

IgG1 antibodies exist in various allotypes and isoallotypes. In various embodiments, one or both of the Fc region or Fc domain of the CD3-targeting heavy chain and the HIV antigen-targeting heavy chain include an IgG1 heavy chain having an allotype of G1m1; nG1m2; G1m3; G1m17, 1; G1m17, 1,2; G1m3,1; or G1m17. Each of these allotypes or isoallotypes is characterized by the following amino acid residues at the indicated positions within the IgG1 heavy chain constant region (Fc) (EU numbering):

G1m1: D356, L358;
nG1m1: E356, M358;
G1m3: R214, E356, M358, A431;
G1m17,1: K214, D356, L358, A431;
G1m17,1,2: K214, D356, L358, G431;
G1m3,1: R214, D356, L358, A431; and
G1m17: K214, E356, M358, A431.

In certain embodiments, the Fc region or Fc domain of the multi-specific antigen binding molecule comprises a wild-type IgG1m3 sequence (e.g., SEQ ID NO: 1089), or has at least 80%, at least 85%, at least 90%, at least 91%, at least 92%, at least 93%, at least 94%, at least 95%, at least 96%, at least 97%, at least 98%, or at least 99% identical to a wild-type IgG1m3 sequence (e.g., SEQ ID NO: 1089), as provided below.

(SEQ ID NO: 1089)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In certain embodiments, the Fc region or Fc domain of one or both of the CD3-targeting heavy chain and the HIV antigen-targeting heavy chain is from an IgG1 isotype. In some embodiments, the Fc region or Fc domain of one or both of the CD3-targeting heavy chain and the HIV antigen-targeting heavy chain contains a human IgG1 constant region. In some embodiments, the human IgG1 Fc region contains one or more modifications. For example, in some embodiments, the Fc region contains one or more amino acid substitutions (e.g., relative to a wild-type Fc region of the same isotype). In some embodiments, the one or more amino acid substitutions are selected from N297A, N297Q (Bolt S et al. (1993) Eur J Immunol 23:403-411), D265A, L234A, L235A (McEarchem et al., (2007) Blood, 109:1185-1192), C226S, C229S (McEarchem et al., (2007) Blood. 109:1185-1192), P238S (Davis et al., (2007) J Rheumatol, 34:2204-2210), E233P, L234V (McEarchem et al., (2007)

Blood, 109:1185-1192), P238A, A327Q, A327G, P329A (Shields R L. et al., (2001) J Biol Chem. 276(9):6591-604), K322A, L234F, L235E (Hezareh, et al., (2001) J Virol 75, 12161-12168; Oganesyan et al., (2008). Acta Crystallographica 64, 700-704), P331S (Oganesyan et al., (2008) Acta Crystallographica 64, 700-704), T394D (Wilkinson et al. (2013) MAbs 5(3): 406-417), A330L, M252Y, S254T, and T256E, where the amino acid position is according to the EU numbering convention. In certain embodiments, the Fc region further includes an amino acid deletion at a position corresponding to glycine 236 according to the EU numbering convention.

In some embodiments, the Fc region or Fc domain of one or both of the CD3-targeting heavy chain and the HIV antigen-targeting heavy chain has an IgG1 isotype with a heavy chain constant region that contains a C220S amino acid substitution according to the EU numbering convention.

In some embodiments, the Fc region comprises a human IgG1 isotype and comprises one or more amino acid substitutions in the Fc region at a residue position selected from the group consisting of: N297A, N297G, N297Q, N297G, D265A, L234A, L235A, C226S, C229S, P238S, E233P, L234V, P238A, A327Q, A327G, P329A, P329G, K322A, L234F, L235E, P331S, T394D, A330L, M252Y, S254T, T256E, M428L, N434S, T366W, T366S, L368A, Y407V and any combination thereof, wherein the numbering of the residues is according to EU numbering. In some embodiments, the Fc region comprises a human IgG1 isotype and comprises one or more amino acid substitutions in the Fc region at a residue position selected from the group consisting of: L234A, L234V, L234F, L235A, L235E, A330L, P331S, and any combination thereof, wherein the numbering of the residues is according to EU numbering. In some embodiments, the Fc region comprises a human IgG1 isotype and comprises the amino acid substitutions in the Fc region of L234A, L235A, and P331S, wherein the numbering of the residues is according to EU numbering. In some embodiments, the Fc region comprises a human IgG1 isotype and comprises the amino acid substitutions in the Fc region of M252Y, S254T, T256E, wherein the numbering of the residues is according to EU numbering. In some embodiments, the Fc region comprises a human IgG1 isotype and comprises the amino acid substitutions in the Fc region of T366S, L368A, Y407V, wherein the numbering of the residues is according to EU numbering. In some embodiments, the Fc region comprises a human IgG1 isotype and comprises the amino acid substitutions in the Fc region of L234A, L235A, P331S, T366S, L368A and Y407V, wherein the numbering of the residues is according to EU numbering. In some embodiments, the Fc region comprises a human IgG1 isotype and comprises the amino acid substitutions in the Fc region of L234A, L235A, P331S, M252Y, S254T and T256E, wherein the numbering of the residues is according to EU numbering.

IgG4 Isotype Fc

For uses where effector function is to be avoided altogether, e.g. when antigen binding alone is sufficient to generate the desired therapeutic benefit, and effector function only leads to (or increases the risk of) undesired side effects, IgG4 antibodies may be used, or antibodies or fragments lacking the Fc region or a substantial portion thereof can be devised, or the Fc may be mutated to eliminate glycosylation altogether (e.g. N297A). Alternatively, a hybrid construct of human IgG2 (CH1 domain and hinge region) and human IgG4 (CH2 and CH3 domains) has been generated that is devoid of effector function, lacking the ability to bind the FcγRs (like IgG2) and unable to activate complement (like IgG4). (see, Rother et al. (2007) Nat. Biotechnol. 25:1256; Mueller et al. (1997) Mol. Immunol. 34:441; and Labrijn et al. (2008) Curr. Op. Immunol. 20:479, discussing Fc modifications to reduce effector function generally).

In certain embodiments, the Fc region or Fc domain of one or both of the CD3-targeting heavy chain and the HIV antigen-targeting heavy chain has an IgG4 isotype. In some embodiments, the Fc region or Fc domain of one or both of the CD3-targeting heavy chain and the HIV antigen-targeting heavy chain contains a human IgG4 constant region. In some embodiments, the human IgG4 constant region includes an Fc region. In some embodiments, the Fc region contains one or more modifications. For example, in some embodiments, the Fc region contains one or more amino acid substitutions (e.g., relative to a wild-type Fc region of the same isotype). In some embodiments, the one or more amino acid substitutions are selected from E233P, F234V, F234A, L235A, G237A, E318A, S228P, L235E, T394D, M252Y, S254T, T256E, N297A, N297G, N297Q, T366W, T366S, L368A, Y407V, M428L, N434S, and any combination thereof, where the amino acid position is according to the EU numbering convention. See, e.g., Hutchins et al. (1995) Proc Natl Acad Sci USA, 92:11980-11984; Reddy et al., (2000) J Immunol, 164:1925-1933; Angal et al., (1993) Mol Immunol. 30(1):105-8; U.S. Pat. No. 8,614,299 B2; Vafa O. et al., (2014) Methods 65:114-126; and Jacobsen et. al., J. Biol. Chem. (2017) 292(5):1865-1875. In some embodiments, the Fc region comprises a human IgG4 isotype and comprises one or more amino acid substitutions in the Fc region at a residue position selected from the group consisting of: F234V, F234A, L235A, L235E, S228P, and any combination thereof, wherein the numbering of the residues is according to EU numbering.

In some embodiments, an IgG4 variant of the present disclosure may be combined with at least one of an S228P mutation according to the EU numbering convention (Angal et al., (1993) Mol Immunol, 30:105-108) and with one or more mutations described in Peters et al., (2012) J Biol Chem. 13; 287(29):24525-33) to enhance antibody stabilization.

IgG2 Isotype Fc

In certain embodiments, the Fc region or Fc domain of one or both of the CD3-targeting heavy chain and the HIV antigen-targeting heavy chain has an IgG2 isotype. In some embodiments, the Fc region or Fc domain of one or both of the CD3-targeting heavy chain and the HIV antigen-targeting heavy chain contains a human IgG2 constant region. In some embodiments, the human IgG2 constant region includes an Fc region. In some embodiments, the Fc region contains one or more modifications. For example, in some embodiments, the Fc region contains one or more amino acid substitutions (e.g., relative to a wild-type Fc region of the same isotype). In some embodiments, the one or more amino acid substitutions are selected from P238S, V234A, G237A, H268A, H268Q, H268E, V309L, N297A, N297G, N297Q, V309L, A330S, P331 S, C232S, C233S, M252Y, S254T, and T256E, where the amino acid position is according to the EU numbering convention (Vafa, et al., (2014) Methods 65:114-126).

Fc Mutations that Increase Serum Half-Life

In some embodiments, the Fc region or Fc domain of one or both of the CD3-targeting heavy chain and the HIV antigen-targeting heavy chain comprise amino acid modifications that promote an increased serum half-life of the multi-specific antigen binding molecule. Mutations that increase the half-life of an antibody have been described. In one embodiment, the Fc region or Fc domain of one or both of the CD3-targeting heavy chain and the HIV antigen-targeting heavy chain comprise a methionine to tyrosine substitution at position 252 (EU numbering), a serine to threonine substitution at position 254 (EU numbering), and a threonine to glutamic acid substitution at position 256 (EU numbering). See, e.g., U.S. Pat. No. 7,658,921. This type of mutant, designated as a "YTE mutant" exhibits a four-fold increased half-life relative to wild-type versions of the same antibody (Dall'Acqua, et al., J Biol Chem, 281: 23514-24 (2006); Robbie, et al., Antimicrob Agents Chemotherap., 57(12):6147-6153 (2013)). In certain embodiments, the Fc region or Fc domain of one or both of the CD3-targeting heavy chain and the HIV antigen-targeting heavy chain comprise an IgG constant domain comprising one, two, three or more amino acid substitutions of amino acid residues at positions 251-257, 285-290, 308-314, 385-389, and 428-436 (EU numbering). Alternatively, M428L and N434S ("LS") substitutions can increase the pharmacokinetic (PK) half-life of the multi-specific antigen binding molecule. In other embodiments, the Fc region or Fc domain of one or both of the CD3-targeting heavy chain and the HIV antigen-targeting heavy chain comprise a M428L and N434S substitution (EU numbering). In other embodiments, the Fc region or Fc domain of one or both of the CD3-targeting heavy chain and the HIV antigen-targeting heavy chain comprise T250Q and M428L (EU numbering) mutations. In other embodiments, the Fc region or Fc domain of one or both of the CD3-targeting heavy chain and the HIV antigen-targeting heavy chain comprise H433K and N434F (EU numbering) mutations.

Fc Mutations that Reduce or Eliminate Effector Activity

In some embodiments, the Fc region or Fc domain of one or both of the CD3-targeting heavy chain and the HIV antigen-targeting heavy chain have amino acid substitutions that reduce or eliminate Fc effector function (including, e.g., antibody-dependent cellular cytotoxicity (ADCC), antibody-dependent cellular phagocytosis (ADCP), and complement-dependent cytotoxicity (CDC)).

In some embodiments, the Fc region is altered by replacing at least one amino acid residue with a different amino acid residue to reduce or eliminate effector function(s) of the antibody. For example, one or more amino acids selected from amino acid residues 234, 235, 236, 237, 297, 318, 320 and 322 (EU numbering) can be replaced with a different amino acid residue such that the multi-specific antigen binding molecule has decreased affinity for an effector ligand. The effector ligand to which affinity is altered can be, for example, an Fc receptor (e.g., at residue positions 234, 235, 236, 237, 297 (EU numbering)) or the C1 component of complement (e.g., at residue positions 297, 318, 320, 322 (EU numbering)). U.S. Pat. Nos. 5,624,821 and 5,648,260, both by Winter et al.

Fc modifications reducing or eliminating effector function include substitutions, insertions, and deletions, e.g., at one or more positions including 234, 235, 236, 237, 267, 269, 325, and 328, e.g., 234G, 235G, 236R, 237K, 267R, 269R, 325L, and 328R (EU numbering). Further, an Fc variant may comprise 236R/328R. Other modifications for reducing FcγR and complement interactions include substitutions at positions 297A, 234A, 235A, 318A, 228P, 236E, 268Q, 309L, 330S, 331S, 220S, 226S, 229S, 238S, 233P, and 234V (EU numbering). These and other modifications are reviewed in Strohl (2009) Current Opinion in Biotechnology 20:685-691. Effector functions (both ADCC and complement activation) can be reduced, while maintaining neonatal FcR binding (maintaining half-life), by mutating IgG residues at one or more of positions 233-236 and 327-331, such as E233P, L234V, L235A, optionally G236A, A327G, A330S and P331S in IgG1; E233P, F234V, L235A, optionally G236A, in IgG4; and A330S and P331S in IgG2 (EU numbering). See Armour et al. (1999) Eur. J. Immunol. 29:2613; WO 99/58572. Other mutations that reduce effector function include L234A and L235A ("LALA") in IgG1 (Alegre et al. (1994) Transplantation 57:1537); V234A and G237A in IgG2 (Cole et al. (1997) J. Immunol. 159:3613; see also U.S. Pat. No. 5,834,597); and S228P and L235E for IgG4 (Reddy et al. (2000) J. Immunol. 164:1925). Another combination of mutations for reducing effector function in a human IgG1 include L234F, L235E and P331S. Oganesyan et al. (2008) Acta Crystallogr. D. Biol. Crystallogr. 64:700. See generally Labrijn et gal. (2008) Curr. Op. Immunol. 20:479. Additional mutations found to decrease effector function in the context of an Fc (IgG1) fusion protein (abatacept) include C226S, C229S and P238S (EU numbering). Davis et al. (2007) J. Immunol. 34:2204.

ADCC activity may be reduced by modifying the Fc region. In certain embodiments, sites that affect binding to Fc receptors may be removed, e.g., sites other than salvage receptor binding sites. In other embodiments, an Fc region may be modified to remove an ADCC site. Exemplary ADCC sites have been described with respect to ADCC sites in IgG1 (Sarmay, et al, (1992) Molec. Immunol. 29 (5): 633-9). In one embodiment, the G236R and L328R variant of human IgG1 effectively eliminates FcγR binding (Horton, et al. (2011) J. Immunol. 186:4223 and Chu, et al. (2008) Mol. Immunol. 45:3926). In other embodiments, the Fc having reduced binding to FcγRs comprises the amino acid substitutions L234A, L235E and G237A. Gross, et al. (2001) *Immunity* 15:289. Modifications in the IgG Fc region to decrease binding to FcγRI to decrease ADCC (e.g., 234A; 235E; 236A; G237A) identified in WO 88/007089 can be used in the present fusion proteins. See also Duncan & Winter (1988) Nature 332:563; Chappel et al. (1991) Proc. Nat'l Acad. Sci. (USA) 88:9036; and Sondermann et al. (2000) Nature 406:267 (discussing the effects of these mutations on FcγRIII binding). In some embodiments, the Fc having reduced binding to FcγRs comprises the amino acid substitutions L234A and L235A.

CDC activity may also be reduced by modifying the Fc region. Mutations at IgG1 positions D270, K322, P329 and P331, specifically alanine mutations D270A, K322A, P329A and P331A, significantly reduce the ability of the corresponding antibody to bind C1q and activate complement (Idusogie et al. (2000) J. Immunol. 164:4178; WO 99/51642. Modification of position 331 of IgG1 (e.g. P331S) has been shown to reduce complement binding (Tao et al. (1993) J. Exp. Med. 178:661; Xu Y, et al. J Biol Chem. 1994. 269:3469-74; and Canfield & Morrison (1991) J. Exp. Med. 173:1483). In another example, one or more amino acid residues within amino acid positions 231 to 239 are altered to thereby reduce the ability of the antibody to fix complement (WO 94/29351). Modifications in the IgG Fc region identified in WO 88/007089 that reduce or eliminate binding to complement component C1q, and therefore reduce or eliminate CDC (e.g., E318A or V/K320A and K322A/Q) can be used in the present fusion proteins.

In some embodiments, the Fc with reduced complement fixation has the amino acid substitutions A330S and P331S. Gross et al. (2001) Immunity 15:289. In some embodiments, the Fc with reduced complement fixation has the amino acid substitution P331S.

In certain embodiments, the Fc region or Fc domain of one or both of the
CD3-targeting heavy chain and the HIV antigen-targeting heavy chain have essentially no effector function, e.g., one or both of the Fc domains have reduced or eliminated binding to FcγRs and reduced or eliminated complement fixation, e.g., is effectorless. An exemplary IgG1 Fc that is effectorless comprises the following five mutations: L234A, L235E, G237A, A330S and P331S (EU numbering) (Gross et al. (2001) Immunity 15:289). These five substitutions may be combined with N297A to eliminate glycosylation as well.

In certain embodiments, the multi-specific antigen binding molecules comprise the L234F, L235E, D264A mutations, which are collectively referred to as "FEA." The FEA mutations decrease or abrogate effector function. In certain embodiments, the multi-specific antigen binding molecules comprise the L234F, L235E, D264A, and F405L mutations, which are collectively referred to as "FEAL." In certain embodiments, the multi-specific antigen binding molecules comprise the L234F, L235E, D264A, and a mutation selected from the group consisting of F405L, F405A, F405D, F405E, F405H, F405I, F405K, F405M, F405N, F405Q, F405S, F405T, F405V, F405W, and F405Y. In certain embodiments, the multi-specific antigen binding molecules comprise the L234F, L235E, D264A, and K409R mutations, which are collectively referred to as "FEAR." In certain embodiments, FEAL and FEAR are comprised in a multi-specific antigen binding molecule described herein. In certain embodiments, the multi-specific antigen binding molecules additionally comprise the M428L and N434S mutations, which are collectively referred to as LS. In certain embodiments, the multi-specific antigen binding molecules comprise the L234F, L235E, D264A, F405L, M428L, and N434S mutations, which are collectively referred to as "FEALLS." In certain embodiments, the multi-specific antigen binding molecules comprise the L234F, L235E, D264A, M428L, and N434S mutations along with one further mutation selected from the group consisting of F405L, F405A, F405D, F405E, F405H, F405I, F405K, F405M, F405N, F405Q, F405S, F405T, F405V, F405W, and F405Y. In certain embodiments, the multi-specific antigen binding molecules comprise the L234F, L235E, D264A, K409R, M428L, and N434S mutations which are collectively referred to as "FEARLS." In certain embodiments, FEALLS and FEARLS are comprised in a multi-specific antigen binding molecule described herein.

Other Fc variants having one or both of reduced ADCC and reduced CDC are disclosed at Glaesner et al. (2010) Diabetes Metab. Res. Rev. 26:287 (F234A and L235A to decrease ADCC and ADCP in an IgG4); Hutchins et al. (1995) Proc. Nat'l Acad. Sci. (USA) 92:11980 (F234A, G237A and E318A in an IgG4); An et al. (2009) MAbs 1:572 and U.S. Pat. App. Pub. 2007/0148167 (H268Q, V309L, A330S and P331S in an IgG2); McEarchern et al. (2007) Blood 109:1185 (C226S, C229S, E233P, L234V, L235A in an IgG1); Vafa et al. (2014) Methods 65:114 (V234A, G237A, P238S, H268A, V309L, A330S, P331S in an IgG2) (EU numbering).

By reducing or abrogating effector function on the Fc domains of the CD3×gp120 multi-specific/bispecific antigen binding molecule (i) T-cells bound by the molecule, including those not infected with HIV, are not killed by innate effector cells e.g., NK cells, macrophages; and (ii) T-cells are not activated in the absence of target cells due to reduced binding to FcγRs on innate effector cells. Activation of T-cells in the absence of target cells could lead to an intolerable cytokine response. Binding of the bispecific molecule to FcγRs on innate effector cells could lead to clustering of the CD3 molecules on the T-cells, resulting in antigen-independent T-cell activation.

Fc Mutations that Facilitate Heterodimerization

In some embodiments, first and second Fc domains have mutations to facilitate heterodimerization. Mutations in Fc domain pairs that facilitate or promote heterodimerization are reviewed in Ha, et al., Front. Immunol. (2016) 7:394. In some embodiments, the first Fc domain and the second Fc domain comprise the following amino acid substitutions (EU numbering), respectively (or vice versa): T366W and T366S/L368A/Y407V; T366W/S354C and T366S/L368A/Y407V/Y349C; S364H/F405A and Y349T/T394; T350V/L351Y/F405A/Y407V and T350V/T366L/K392L/T394W; K360D/D399M/Y407A and E345R/Q347R/T366V/K409V; K409D/K392D and D399K/E356K; K360E/K409W and Q347R/D399V/F405T; K360E/K409W/Y349C and Q347R/D399V/F405T/S354C; or K370E/K409W and E357N/D399V/F405T. In some embodiments, the first Fc domain and the second Fc domain comprise the following amino acid substitutions (EU numbering), respectively (or vice versa): T366W and T366S/L368A/Y407V.

In some embodiments, Fc region heterodimerization of the two different heavy chain-containing species can be facilitated by so-called 'knobs-into-holes' mutations (Atwell et al. 1997. JMB 270:26-35). The 'hole' mutations (T366S, L368A and Y407V ("SAV")) are incorporated into one Fc-containing chain, the T366W 'knob' ("W") mutation is incorporated into the other chain. In addition, a C220S mutation can be incorporated into an IgG1 hinge region of a scFv-containing arm to eliminate a free cysteine that otherwise forms a disulfide bond with a corresponding cysteine in the light chain in a wild-type IgG1. Co-transfection of such constructs leads to preferential formation of a heterodimeric Fc, with low levels of homodimer contaminants. Additionally, incorporating a S354C mutation can be incorporated into the Fc containing the 'knob' mutations and a Y349C mutation into the Fc containing the 'hole' mutations can optionally be used to generate a covalent bond between the two halves of the heterodimeric Fc if additional thermodynamic stability is desired (Merchant et al. 1998. Nat. Biotechnol. 16: 677-81).

To facilitate purification of the heterodimeric molecule away from contaminating homodimeric products, the H435R ("R") or H435R+Y436F ("RF") mutations to reduce or eliminate Protein A binding can be introduced into one but not both of the Fc-containing chains (Jendeberg, L. et al. 1997 J. Immunol. Methods 201:25-34). This reduces or eliminates Protein A binding of the homodimer contaminant containing these mutations, and greatly simplifies purification of the desired heterodimer away from remaining homodimer contaminant via additional chromatography steps (e.g. ion exchange). In embodiments incorporating H435R (or H435R+Y436F) mutations in the first or second Fc region of a heavy chain, if the VH region in the same heavy chain is from a VH3 family variable region, this VH region can also include amino acid substitutions, as described herein, to reduce or eliminate Protein A binding of the entire heavy chain. In some embodiments, the H435R is introduced into one of the Fc-containing chains.

In certain embodiments, the one or more modifications are selected from the following Fc amino acid substitutions (EU numbering) or combinations thereof: L234F; L235E; G236A; S239D; F243L; D265E; D265A; S267E; H268F; R292P; N297Q; N297A; S298A; S324T; I332E; S239D; A330L; L234F; L235E; P331S; F243L; Y300L; V305I; P396L; S298A; E333A; K334A; E345R; L235V; F243L;

R292P; Y300L; P396L; M428L; E430G; N434S; G236A, S267E, H268F, S324T, and I332E; G236A, S239D, and I332E; S239D, A330L, I332E; L234F, L235E, and P331S; F243L, R292P, Y300L, V305I, and P396L; G236A, H268F, S324T, and I332E; S239D, H268F, S324T, and I332E; S298A, E333A, and K334A; L235V, F243L, R292P, Y300L, and P396L; S239D, I332E; S239D, S298A, and I332E; G236A, S239D, I332E, M428L, and N434S; G236A, S239D, A330L, I332E, M428L, and N434S; S239D, I332E, G236A and A330L; M428L and N4343S; M428L, N434S; G236A, S239D, A330L, and I332E; and G236A and I332E. In certain embodiments, the one or more modifications is selected from the group consisting of: N297A, D265A, L234F, L235E, N297Q, and P331S. In certain embodiments, the one or more modifications is N297A or D265A. In certain embodiments the one or more modifications are L234F and L235E. In certain embodiments, the one or more modifications are L234F, L234E, and D265A. In certain embodiments, the one or more modifications are L234F, L234E, and N297Q. In certain embodiments, the one or more modifications are L234F, L235E, and P331S. In certain embodiments, the one or more modifications are D265A and N297Q. In certain embodiments, the one or more modifications are L234F, L235E, D265A, N297Q, and P331S. In some embodiments the modifications are L234A, L235A, P331S, T366S, L368A, Y407V and H435R. In some embodiments the modifications are L234A, L235A, P331S, T366W, M252Y, S254T and T256E.

Combined mutations that reduce Fc-receptor binding and find use in the present antigen binding molecules include, for example, N297A; N297Q; D265A; L234F/L235E; L234F/L235E/N297Q; L234F/L235E/P331S; D265A/N297Q; and L234F/L235E/D265A/N297Q/P331S (all EU numbering). In certain embodiments the multi-specific antigen binding molecules described herein comprise L234F and L235E mutations. In certain embodiments the multi-specific antigen binding molecules described herein comprise L234F, L235E, and D265A mutations. In certain embodiments the multi-specific antigen binding molecules described herein comprise L234F, L235E, and N297Q mutations. In certain embodiments the multi-specific antigen binding molecules described herein comprise an N297A or N297Q mutation. In certain embodiments the multi-specific antigen binding molecules described herein comprise an N297A or N297Q mutation as well as L234F, L235E, and D265A mutations. In certain embodiments, one, two, three, four, or more amino acid substitutions are introduced into a Fc region to alter the effector function of the antigen binding molecule. For example, these substitutions are located at positions selected from the group consisting of amino acid residues 234, 235, 236, 237, 265, 297, 318, 320, and 322, (according to EU numbering). These positions can be replaced with a different amino acid residue such that the antigen binding molecule has an altered (e.g., reduced) affinity for an effector ligand (e.g., an Fc receptor or the C1 component of complement), but retains the antigen binding ability of the parent antibody. In certain embodiments, the multi-specific antigen binding molecules described herein comprise one or more of E233P, L234V, L235A, and G236A mutations (EU numbering). In some embodiments, the multi-specific antigen binding molecules comprise one or more of A327G, A330S, and P331S mutations (EU numbering). In some embodiments, the multi-specific antigen binding molecules comprise K322A mutations (EU numbering). In some embodiments the multi-specific antigen binding molecules comprise E318A, K320A, and K322A (EU numbering) mutations. In certain embodiments, the multi-specific antigen binding molecules comprise a L235E (EU numbering) mutation.

In some embodiments, the Fc region or Fc domain of one or both of the CD3-targeting heavy chain and the HIV antigen-targeting heavy chain does not comprise a hinge region; or the hinge region is truncated or deleted, in whole or in part. The structural hinge region of human IgG1, IgG2 and IgG4 antibodies is a peptide linker of 19 to 23 amino acids containing two to four cysteine residues, is genetically encoded on the hinge exon together with the 5'-end of the CH2 exon, and allows for disulfide bridges between first and second Fc domains (Roux, et al., *J. Immunol.* (1998) 161: 4083). The structural hinge region is comprised of amino acid residue positions 216-238 (EU numbering) or 226-251 (Kabat numbering) (identified on imgt.org). In some embodiments, the Fc region or Fc domain of one or both of the CD3-targeting heavy chain and the HIV antigen-targeting heavy chain comprises or is derived from a human IgG4 isotype and does not comprise the amino acid sequence ESKYGPPCPPCP (SEQ ID NO: 504). In some embodiments, the Fc region or Fc domain of one or both of the CD3-targeting heavy chain and the HIV antigen-targeting heavy chain comprises or is derived from a human IgG1 isotype and does not comprise the amino acid sequence EPKSCDKTHTCPPCP (SEQ ID NO: 993) or EPKSCDKTHTCPPCPAPELL (SEQ ID NO: 994). As appropriate, the hinge region of the Fc domain of one or both of the CD3-targeting heavy chain and the HIV antigen-targeting heavy chain can be the same or different.

In various embodiments, the Fc region or Fc domain of the CD3-targeting heavy chain and the HIV antigen-targeting heavy chain comprise a heterodimeric human IgG1, comprising amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs.: 696 and 697; SEQ ID NOs.: 697 and 696; SEQ ID NOs.: 696 and 698; SEQ ID NOs.: 698 and 696; SEQ ID NOs.: 699 and 700; SEQ ID NOs.: 700 and 699; SEQ ID NOs.: 701 and 698; SEQ ID NOs.: 698 and 701; SEQ ID NOs.: 702 and 703; SEQ ID NOs.: 703 and 702; SEQ ID NOs.: 704 and 698; SEQ ID NOs.: 698 and 704; SEQ ID NOs.: 705 and 703; SEQ ID NOs.: 703 and 705; SEQ ID NOs.: 706 and 704; SEQ ID NOs.: 704 and 706; SEQ ID NOs.: 707 and 703; SEQ ID NOs.: 703 and 707; SEQ ID NOs.: 708 and 704; SEQ ID NOs.: 704 and 708; SEQ ID NOs.: 709 and 710; or SEQ ID NOs.: 710 and 709.

In some embodiments, the Fc region or Fc domain of the CD3-targeting heavy chain and the HIV antigen-targeting heavy chain comprise a heterodimeric human IgG1, comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs.: 703 and 705. In some embodiments the Fc region or Fc domain of the CD3-targeting heavy chain and the HIV antigen-targeting heavy chain comprise a heterodimeric human IgG1, comprising amino acid sequences that are at least 95% identical to the amino acid sequences set forth, respectively: SEQ ID NOs.: 703 and 705. In some embodiments, the Fc region or Fc domain of the CD3-targeting heavy chain and the HIV antigen-targeting heavy chain comprise a heterodimeric human IgG1, comprising amino acid sequences that are at least 99% identical to the amino acid sequences set forth, respectively: SEQ ID NOs.: 703 and 705. In some embodiments, the Fc region or Fc domain of the CD3-targeting heavy chain and the HIV antigen-targeting heavy chain comprise a heterodimeric human IgG1, comprising amino acid sequences set forth, respectively: SEQ ID NOs.: 703 and 705.

Illustrative sequences of complementarity first and second Fc domain pairs of the multi-specific antigen binding molecules, targeting HIV gp120, are provided in Table F. In some embodiments, the first Fc domain in a Fc domain pair is fused to the first antigen binding domain, targeting CD3. In such embodiments, the second Fc domain in a Fc domain pair is fused to the second antigen binding domain, targeting an HIV antigen. In some embodiments, the second Fc domain in a Fc domain pair is fused to the first antigen binding domain, targeting CD3. In such embodiments, the first Fc domain in a Fc domain pair is fused to the second antigen binding domain, targeting an HIV antigen.

TABLE F

| Fc regions - Heterodimeric pairs | | | | |
|---|---|---|---|---|
| Fc aa subst | SEQ ID NO: | | Fc aa subst | SEQ ID NO: |
| L234A, L235A, P331S, T366W | 696 | EPKSCDKTHTCPPCPAPEAAGGPSVFLFP PKPKDTLMISRTPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLWCLVKGFYPSDIAVEWESNGQPEN NYKTTPPVLDSDGSFFLYSKLTVDKSRWQ QGNVFSCSVMHEALHNHYTQKSLSLSPGK | L234A, L235A, P331S, T366S, L368A, Y407V, H435R, Y436F | 697 | EPKSSDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRFTQKSLSLSPGK |
| L234A, L235A, P331S, T366W | 696 | EPKSCDKTHTCPPCPAPEAAGGPSVFLFP PKPKDTLMISRTPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLWCLVKGFYPSDIAVEWESNGQPEN NYKTTPPVLDSDGSFFLYSKLTVDKSRWQ QGNVFSCSVMHEALHNHYTQKSLSLSPGK | L234A, L235A, P331S, T366S, L368A, Y407V, H435R | 698 | EPKSSDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |
| L234A, L235A, P331S, T366S, L368A, Y407V | 699 | EPKSCDKTHTCPPCPAPEAAGGPSVFLFP PKPKDTLMISRTPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLSCAVKGFYPSDIAVEWESNGQPEN NYKTTPPVLDSDGSFFLVSKLTVDKSRWQ QGNVFSCSVMHEALHNHYTQKSLSLSPGK | L234A, L235A, P331S, T366W | 700 | EPKSSDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL WCLVKGFYPSDIAVEWESNGQPENNYKTTP PVLDSDGSFFLYSKLTVDKSRWQQGNVFSC SVMHEALHNHYTQKSLSLSPGK |
| L234A, L235A, P331S, T366W, M428L, N434S | 701 | EPKSCDKTHTCPPCPAPEAAGGPSVFLFP PKPKDTLMISRTPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLWCLVKGFYPSDIAVEWESNGQPEN NYKTTPPVLDSDGSFFLYSKLTVDKSRWQ QGNVFSCSVLHEALHSHYTQKSLSLSPGK | L234A, L235A, P331S, T366S, L368A, Y407V, H435R | 698 | EPKSSDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |
| L234A, L235A, P331S, T366W, M428L, N434S | 702 | SDKTHTCPPCPAPEAAGGPSVFLFPPKPK DTLMISRTPEVTCVVVDVSHEDPEVKFNW YVDGVEVHNAKTKPREEQYNSTYRVVSVL TVLHQDWLNGKEYKCKVSNKALPASIEKT ISKAKGQPREPQVYTLPPSREEMTKNQVS LWCLVKGFYPSDIAVEWESNGQPENNYKT TPPVLDSDGSFFLYSKLTVDKSRWQQGNV FSCSVLHEALHSHYTQKSLSLSPGK | L234A, L235A, P331S, T366S, L368A, Y407V, H435R | 703 | EPKSCDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |
| L234A, L235A, P331S, T366W, M252Y, S254I, T256E | 704 | EPKSCDKTHTCPPCPAPEAAGGPSVFLFP PKPKDTLYITREPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLWCLVKGFYPSDIAVEWESNGQPEN NYKTTPPVLDSDGSFFLYSKLTVDKSRWQ QGNVFSCSVMHEALHNHYTQKSLSLSPGK | L234A, L235A, P331S, T366S, L368A, Y407V, H435R | 698 | EPKSSDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |
| L234A, L235A, P331S, T366W, M252Y, S254I, T256E | 705 | SDKTHTCPPCPAPEAAGGPSVFLFPPKPK DTLYITREPEVTCVVVDVSHEDPEVKFNW YVDGVEVHNAKTKPREEQYNSTYRVVSVL TVLHQDWLNGKEYKCKVSNKALPASIEKT ISKAKGQPREPQVYTLPPSREEMTKNQVS LWCLVKGFYPSDIAVEWESNGQPENNYKT TPPVLDSDGSFFLYSKLTVDKSRWQQGNV FSCSVMHEALHNHYTQKSLSLSPGK | L234A, L235A, P331S, T366S, L368A, Y407V, H435R | 703 | EPKSCDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |

TABLE F-continued

Fc regions - Heterodimeric pairs

| Fc aa subst | SEQ ID NO: | | Fc aa subst | SEQ ID NO: | |
|---|---|---|---|---|---|
| L234A, L235A, P331S, T366S, L368A, Y407V, H435R | 706 | SDKTHTCPPCPAPEAAGGPSVFLFPPKPK DTLMISRTPEVTCVVVDVSHEDPEVKFNW YVDGVEVHNAKTKPREEQYNSTYRVVSVL TVLHQDWLNGKEYKCKVSNKALPASIEKT ISKAKGQPREPQVYTLPPSREEMTKNQVS LSCAVKGFYPSDIAVEWESNGQPENNYKT TPPVLDSDGSFFLVSKLTVDKSRWQQGNV FSCSVMHEALHNRYTQKSLSLSPGK | L234A, L235A, P331S, T366W, M252Y, S254I, T256E | 704 | EPKSCDKTHTCPPCPAPEAAGGPSVFLFPP KPKDTLYITREPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL WCLVKGFYPSDIAVEWESNGQPENNYKTTP PVLDSDGSFFLYSKLTVDKSRWQQGNVFSC SVMHEALHNHYTQKSLSLSPGK |
| L234A, L235A, P331S + T366W | 707 | SDKTHTCPPCPAPEAAGGPSVFLFPPKPK DTLMISRTPEVTCVVVDVSHEDPEVKFNW YVDGVEVHNAKTKPREEQYNSTYRVVSVL TVLHQDWLNGKEYKCKVSNKALPASIEKT ISKAKGQPREPQVYTLPPSREEMTKNQVS LWCLVKGFYPSDIAVEWESNGQPENNYKT TPPVLDSDGSFFLYSKLTVDKSRWQQGNV FSCSVMHEALHNHYTQKSLSLSPGK | L234A, L235A, P331S + T366S, L368A, Y407V + H435R | 703 | EPKSCDKTHTCPPCPAPEAAGGPSVFLFPP KPKDTLMISRTPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNRYTQKSLSLSPGK |
| L234A, L235A, P331S, T366S, L368A, Y407V, M252Y, S254I, T256E | 708 | SDKTHTCPPCPAPEAAGGPSVFLFPPKPK DTLYITREPEVTCVVVDVSHEDPEVKFNW YVDGVEVHNAKTKPREEQYNSTYRVVSVL TVLHQDWLNGKEYKCKVSNKALPASIEKT ISKAKGQPREPQVYTLPPSREEMTKNQVS LSCAVKGFYPSDIAVEWESNGQPENNYKT TPPVLDSDGSFFLVSKLTVDKSRWQQGNV FSCSVMHEALHNHYTQKSLSLSPGK | L234A, L235A, P331S, T366W, M252Y, S254I, T256E | 704 | EPKSCDKTHTCPPCPAPEAAGGPSVFLFPP KPKDTLYITREPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL WCLVKGFYPSDIAVEWESNGQPENNYKTTP PVLDSDGSFFLYSKLTVDKSRWQQGNVFSC SVMHEALHNHYTQKSLSLSPGK |
| L234A, L235A, P331S, T366S, L368A, Y407V, M252Y, S254I, T256E | 709 | EPKSSDKTHTCPPCPAPEAAGGPSVFLFP PKPKDTLYITREPEVTCVVVDVSHEDPEV KFNWYVDGVEVHNAKTKPREEQYNSTYRV VSVLTVLHQDWLNGKEYKCKVSNKALPAS IEKTISKAKGQPREPQVYTLPPSREEMTK NQVSLWCLVKGFYPSDIAVEWESNGQPEN NYKTTPPVLDSDGSFFLYSKLTVDKSRWQ QGNVFSCSVMHEALHNHYTQKSLSLSPGK | L234A, L235A, P331S, T366W, M252Y, S254I, T256E | 710 | EPKSCDKTHTCPPCPAPEAAGGPSVFLFPP KPKDTLYITREPEVTCVVVDVSHEDPEVKF NWYVDGVEVHNAKTKPREEQYNSTYRVVSV LTVLHQDWLNGKEYKCKVSNKALPASIEKT ISKAKGQPREPQVYTLPPSREEMTKNQVSL SCAVKGFYPSDIAVEWESNGQPENNYKTTP PVLDSDGSFFLVSKLTVDKSRWQQGNVFSC SVMHEALHNHYTQKSLSLSPGK |

In some embodiments, the multi-specific antigen binding molecule comprises a first antigen binding domain that is a scFv and a second antigen binding domain that is a Fab, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 806, 801 and 802; SEQ ID NOs: 806, 803 and 802; SEQ ID NOs: 807, 803 and 802; SEQ ID NOs: 807, 805 and 802; SEQ ID NOs: 808, 809 and 802; SEQ ID NOs: 808, 810 and 802; SEQ ID NOs: 811, 801 and 802; SEQ ID NOs: 812, 809 and 802; SEQ ID NOs: 812, 810 and 802; SEQ ID NOs: 813, 805 and 802; SEQ ID NOs: 812, 814 and 802; SEQ ID NOs: 815, 801 and 802; SEQ ID NOs: 816, 805 and 802; SEQ ID NOs: 817, 801 and 802; SEQ ID NOs: 818, 805 and 802; SEQ ID NOs: 819, 810 and 802; SEQ ID NOs: 820, 810 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 830, 822 and 823; SEQ ID NOs: 830, 825 and 823; SEQ ID NOs: 831, 825 and 823; SEQ ID NOs: 831, 827 and 823; SEQ ID NOs: 832, 833 and 823; SEQ ID NOs: 832, 829 and 823; SEQ ID NOs: 834, 827 and 823; SEQ ID NOs: 835, 829 and 823; SEQ ID NOs: 836, 829 and 823; SEQ ID NOs: 837, 833 and 823; SEQ ID NOs: 837, 838 and 823; SEQ ID NOs: 839, 840 and 823; SEQ ID NOs: 841, 829 and 823; SEQ ID NOs: 842, 829 and 823; SEQ ID NOs: 843, 829 and 823; SEQ ID NOs: 844, 829 and 823; SEQ ID NOs: 845, 829 and 823; SEQ ID NOs: 846, 829 and 823; SEQ ID NOs: 846, 833 and 823; SEQ ID NOs: 846, 838 and 823; SEQ ID NOs: 847, 827 and 823; SEQ ID NOs: 848, 829 and 823; SEQ ID NOs: 849, 829 and 823; SEQ ID NOs: 850, 829 and 823; SEQ ID NOs: 851, 829 and 823; SEQ ID NOs: 852, 829 and 823; SEQ ID NOs: 853, 829 and 823; SEQ ID NOs: 854, 829 and 823; SEQ ID NOs: 855, 829 and 823; SEQ ID NOs: 856, 829 and 823; SEQ ID NOs: 857, 829 and 823; SEQ ID NOs: 858, 829 and 823; SEQ ID NOs: 859, 829 and 823; SEQ ID NOs: 860, 829 and 823; SEQ ID NOs: 861, 862 and 863; SEQ ID NOs: 861, 864 and 863; SEQ ID NOs: 865, 864 and 863; SEQ ID NOs: 865, 866 and 863; SEQ ID NOs: 867, 868 and 863; SEQ ID NOs: 869, 862 and 863; SEQ ID NOs: 869, 864 and 863; SEQ ID NOs: 870, 864 and 863; SEQ ID NOs: 870, 866 and 863; SEQ ID NOs: 871, 872 and 863; SEQ ID NOs: 871, 868 and 863; SEQ ID NOs: 873, 862 and 863; SEQ ID NOs: 874, 866 and 863; SEQ ID NOs: 875, 872 and 863; SEQ ID NOs: 875, 868 and 863; SEQ ID NOs: 875, 876 and 863; SEQ ID NOs: 877, 862 and 863; SEQ ID NOs: 878, 866 and 863; SEQ ID NOs: 879, 862 and 863; SEQ ID NOs: 880, 866 and 863; SEQ ID NOs: 881, 882 and 883; SEQ ID NOs: 881, 884 and 883; SEQ ID NOs: 885, 884 and 883; SEQ ID NOs: 885, 886 and 883; SEQ ID NOs: 887, 888 and 883; SEQ ID NOs: 889, 882 and 883; SEQ ID NOs: 889, 884 and 883; SEQ ID NOs: 890, 884 and 883; SEQ ID NOs: 890, 886 and 883; SEQ ID NOs: 891, 892 and 883; SEQ ID NOs: 891, 888 and 883; SEQ ID NOs: 893, 882 and 883; SEQ ID NOs: 894, 886 and 883; SEQ ID NOs: 895, 892 and 883; SEQ ID NOs: 895, 888 and 883; SEQ ID NOs: 895, 896 and 883; SEQ ID NOs: 897, 882 and 883; SEQ ID NOs: 898, 886 and 883; SEQ ID NOs: 899, 882 and 883; or SEQ ID NOs: 900, 886 and 883.

In some embodiments, the multi-specific antigen binding molecule comprises a first antigen binding domain that is a scFv and a second antigen binding domain that is a Fab, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 806, 801 and 802; SEQ ID NOs: 806, 803 and 802; SEQ ID NOs: 807, 803 and 802; SEQ ID NOs: 807, 805 and 802; SEQ ID NOs: 808, 809 and 802; SEQ ID NOs: 808, 810 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 830, 822 and 823; SEQ ID NOs: 830, 825 and 823; SEQ ID NOs: 831, 825 and 823; SEQ ID NOs: 831, 827 and 823; SEQ ID NOs: 832, 833 and 823; SEQ ID NOs: 832, 829 and 823; SEQ ID NOs: 861, 862 and 863; SEQ ID NOs: 861, 864 and 863; SEQ ID NOs: 865, 864 and 863; SEQ ID NOs: 865, 866 and 863; SEQ ID NOs: 867, 868 and 863; SEQ ID NOs: 869, 862 and 863; SEQ ID NOs: 869, 864 and 863; SEQ ID NOs: 870, 864 and 863; SEQ ID NOs: 870, 866 and 863; SEQ ID NOs: 871, 872 and 863; SEQ ID NOs: 871, 868 and 863; SEQ ID NOs: 881, 882 and 883; SEQ ID NOs: 881, 884 and 883; SEQ ID NOs: 885, 884 and 883; SEQ ID NOs: 885, 886 and 883; SEQ ID NOs: 887, 888 and 883; SEQ ID NOs: 889, 882 and 883; SEQ ID NOs: 889, 884 and 883; SEQ ID NOs: 890, 884 and 883; SEQ ID NOs: 890, 886 and 883; SEQ ID NOs: 891, 892 and 883; or SEQ ID NOs: 891, 888 and 883.

In some embodiments, the multi-specific antigen binding molecule comprises a first antigen binding domain that is a scFv and a second antigen binding domain that is a Fab, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 861, 862 and 863; SEQ ID NOs: 861, 864 and 863; SEQ ID NOs: 865, 864 and 863; SEQ ID NOs: 865, 866 and 863; or SEQ ID NOs: 867, 868 and 863.

In some embodiments, the multi-specific antigen binding molecule comprises a first antigen binding domain that is a scFv and a second antigen binding domain that is a Fab, wherein the first antigen binding domain comprises a first heavy chain (HC), and the second antigen binding domain comprises a second HC and a light chain (LC), the first HC, the second HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 800, 801 and 802; SEQ ID NOs: 800, 803 and 802; SEQ ID NOs: 804, 803 and 802; SEQ ID NOs: 804, 805 and 802; SEQ ID NOs: 821, 822 and 823; SEQ ID NOs: 824, 825 and 823; SEQ ID NOs: 826, 825 and 823; SEQ ID NOs: 826, 827 and 823; SEQ ID NOs: 828, 829 and 823; SEQ ID NOs: 861, 862 and 863; SEQ ID NOs: 861, 864 and 863; SEQ ID NOs: 865, 864 and 863; SEQ ID NOs: 865, 866 and 863; or SEQ ID NOs: 867, 868 and 863.

In some embodiments, the multi-specific antigen binding molecule comprises a first antigen binding domain that is a Fab and a second antigen binding domain that is a scFv or an EC domain of CD4 wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; SEQ ID NOs: 754, 752 and 753; SEQ ID NOs: 755, 756 and 753; SEQ ID NOs: 755, 757 and 753; SEQ ID NOs: 758, 757 and 753; SEQ ID NOs: 759, 756 and 753; SEQ ID NOs: 754, 760 and 761; SEQ ID NOs: 762, 760 and 761; SEQ ID NOs: 751, 763 and 753; SEQ ID NOs: 764, 752 and 753; SEQ ID NOs: 765, 752 and 753; SEQ ID NOs: 766, 767 and 753; SEQ ID NOs: 766, 768 and 753; SEQ ID NOs: 769, 768 and 753; SEQ ID NOs: 770, 767 and 753; SEQ ID NOs: 765, 771 and 761; SEQ ID NOs: 772, 771 and 761; SEQ ID NOs: 774, 775 and 776; SEQ ID NOs: 777, 778 and 776; SEQ ID NOs: 779, 778 and 776; SEQ ID NOs: 779, 780 and 776; SEQ ID NOs: 777, 781 and 776; SEQ ID NOs: 782, 752 and 753; SEQ ID NOs: 783, 752 and 753; SEQ ID NOs: 784, 785 and 753; SEQ ID NOs: 784, 786 and 753; SEQ ID NOs: 787, 786 and 753; SEQ ID NOs: 788, 785 and 753; SEQ ID NOs: 783, 789 and 761; SEQ ID NOs: 790, 789 and 761; SEQ ID NOs: 792, 793 and 794; SEQ ID NOs: 795, 796 and 794; SEQ ID NOs: 797, 796 and 794; SEQ ID NOs: 797, 798 and 794; or SEQ ID NOs: 795, 799 and 794.

In some embodiments, the multi-specific antigen binding molecule comprises a first antigen binding domain that is a Fab and a second antigen binding domain that is a scFv or an EC domain of CD4 wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; SEQ ID NOs: 754, 752 and 753; SEQ ID NOs: 755, 756 and 753; SEQ ID NOs: 755, 757 and 753; SEQ ID NOs: 758, 757 and 753; SEQ ID NOs: 759, 756 and 753; SEQ ID NOs: 764, 752 and 753; SEQ ID NOs: 765, 752 and 753; SEQ ID NOs: 766, 767 and 753; SEQ ID NOs: 766, 768 and 753; SEQ ID NOs: 769, 768 and 753; SEQ ID NOs: 770, 767 and 753; SEQ ID NOs: 777, 778 and 776; SEQ ID NOs: 779, 778 and 776; SEQ ID NOs: 779, 780 and 776; SEQ ID NOs: 777, 781 and 776; SEQ ID NOs: 782, 752 and 753; SEQ ID NOs: 783, 752 and 753; SEQ ID NOs: 784, 785 and 753; SEQ ID NOs: 784, 786 and 753; SEQ ID NOs: 787, 786 and 753; SEQ ID NOs: 788, 785 and 753; SEQ ID NOs: 795, 796 and 794; SEQ ID NOs: 797, 796 and 794; SEQ ID NOs: 797, 798 and 794; or SEQ ID NOs: 795, 799 and 794.

In some embodiments, the multi-specific antigen binding molecule comprises a first antigen binding domain that is a Fab and a second antigen binding domain that is a scFv or an EC domain of CD4 wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; SEQ ID NOs: 754, 752 and 753; SEQ ID NOs: 755, 756 and 753; SEQ ID NOs: 755, 757 and 753; SEQ ID NOs: 758, 757 and 753; or SEQ ID NOs: 759, 756 and 753.

In some embodiments, the multi-specific antigen binding molecule comprises a first antigen binding domain that is a Fab and a second antigen binding domain that is a scFv or an EC domain of CD4 wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753; or SEQ ID NOs: 755, 756 and 753. In some embodiments, the multi-specific antigen binding molecule comprises a first antigen binding domain that is a Fab and a second antigen binding domain that is a scFv or an EC domain of CD4 wherein the first antigen binding domain comprises a first HC and a LC, and the second antigen binding domain comprises a second HC, the second HC, the first HC and the LC comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 755, 756 and 753. In various embodiments, the multi-specific antigen binding molecule has a potency, as measured by EC50, of less than 0.15 µg/mL, e.g., less than 0.14 µg/mL, 0.13 µg/mL, 0.12 µg/mL or 0.11 µg/mL, or less, against at least 30 different HIV isolates. In some embodiments, the multi-specific antigen binding molecule has a potency, as measured by EC50, of less than 0.11 µg/mL against at least 30 different HIV isolates.

In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC, the first HC and the LC comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 751, 752 and 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC, the first HC and the LC comprising amino acid sequences that are at least 95% identical to the amino acid sequences set forth, respectively: SEQ ID NOs: 751, 752 and 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC, the first HC and the LC comprising amino acid sequences that are at least 99% identical to the amino acid sequences set forth, respectively: SEQ ID NOs: 751, 752 and 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, and the first HC and the LC comprising amino acid sequences that are at least 95% (e.g., at least 96%, at least 97%, at least 98%, or at least 99%) identical to the amino acid sequences set forth, respectively: SEQ ID NOs: 752 and 753.

In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, the first HC comprises an amino acid sequence that is at least 95% (e.g., at least 96%, at least 97%, at least 98%, or at least 99%) identical to the amino acid sequence of SEQ ID NO: 752, and the LC comprises an amino acid sequence that is at least 95% (e.g., at least 96%, at least 97%, at least 98%, or at least 99%) identical to the amino acid sequence of SEQ ID NO: 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, the first HC comprises an amino acid sequence of SEQ ID NO: 752, and the LC comprises an amino acid sequence that is at least 95% identical to the amino acid sequence of SEQ ID NO: 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, the first HC comprises an amino acid sequence of SEQ ID NO: 752, and the LC comprises an amino acid sequence that is at least 99% identical to the amino acid sequence of SEQ ID NO: 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, the first HC comprises an amino acid sequence that is at least 95% identical to the amino acid sequence of SEQ ID NO: 752, and the LC comprises an amino acid sequence of SEQ ID NO: 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC comprising an amino acid sequence that is at least 95% (e.g., at least 96%, at least 97%, at least 98%, or at least 99%) identical to the amino acid sequence of SEQ ID NO: 751, the first HC comprises an amino acid sequence that is at least 99% identical to the amino acid sequence of SEQ ID NO: 752, and the LC comprises an amino acid sequence of SEQ ID NO: 753. In some embodiments, the multi-specific antigen binding molecule comprises a first antigen binding domain that is a Fab and a second antigen binding domain that is an EC domain of CD4 wherein the first antigen binding domain comprises a first HC and a LC, and the second antigen binding domain comprises a second HC, the second HC, the first HC and the LC comprising amino acid sequences set forth, respectively: SEQ ID NOs: 751, 752 and 753.

Illustrative sequences of bispecific molecules targeting CD3 and HIV gp120, described herein, are provided in Table G. Bispecific molecules described herein are summarized in Table 53.

TABLE G amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 180 hCD4 D1.22 Fc AAS + W + YTE/ huSP34.39.13 AAS + SAV + R | SEQ ID NO: 751 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGSDKTHTCPPCPAPEAAGGPSVFLF PPKPKDTLYITREPEVTCVVVDVSHEDPEVK FNWYVDGVEVHNAKTKPREEQYNSTYRVVSV LTVLHQDWLNGKEYKCKVSNKALPASIEKTI SKAKGQPREPQVYTLPPSREEMTKNQVSLWC LVKGFYPSDIAVEWESNGQPENNYKTTPPVL DSDGSFFLYSKLTVDKSRWQQGNVFSCSVMH EALHNHYTQKSLSLSPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 181 hCD4 D1.22 Fc AAS + W/ huSP34.39.13 AAS + SAV + R | SEQ ID NO: 754 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGSDKTHTCPPCPAPEAAGGPSVFLF PPKPKDTLMISRTPEVTCVVVDVSHEDPEVK FNWYVDGVEVHNAKTKPREEQYNSTYRVVSV LTVLHQDWLNGKEYKCKVSNKALPASIEKTI SKAKGQPREPQVYTLPPSREEMTKNQVSLWC LVKGFYPSDIAVEWESNGQPENNYKTTPPVL DSDGSFFLYSKLTVDKSRWQQGNVFSCSVMH EALHNHYTQKSLSLSPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVTOVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 182<br>hCD4<br>D1.22 Fc<br>AAS + SAV + R/<br>huSP34.3.13<br>AAS + W + YTE | SEQ ID NO: 755<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGSDKTHTCPPCPAPEAAGGPSVFLF<br>PPKPKDTLMISRTPEVTCVVVDVSHEDPEVK<br>FNWYVDGVEVHNAKTKPREEQYNSTYRVVSV<br>LTVLHQDWLNGKEYKCKVSNKALPASIEKTI<br>SKAKGQPREPQVYTLPPSREEMTKNQVSLSC<br>AVKGFYPSDIAVEWESNGQPENNYKTTPPVL<br>DSDGSFFLVSKLTVDKSRWQQGNVFSCSVMH<br>EALHNRYTQKSLSLSPGK | SEQ ID NO: 756<br>EVQLVESGGGLVQPGGSLRLSCAASGFTFNTYAMN<br>WVRQAPGKGLEWVGRIRSKYNNYATYYADSVKGRF<br>TISRDDSKNSLYLQMNSLRTEDTAVYYCVRHGNFG<br>HSYVSWFAYWGQGTLVTVSSASTKGPSVFPLAPSS<br>KSTSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAGG<br>PSVFLFPPKPKDTLMISRTPEVICVVVDVSHEDPE<br>VKFNWYVDGVEVHNAKTKPREEQYNSTYRVVSVLT<br>VLHQDWLNGKEYKCKVSNKALPASIEKTISKAKGQ<br>PREPQVYTLPPSREEMTKNQVSLWCLVKGFYPSDI<br>AVEWESNGQPENNYKTTPPVLDSDGSFFLYSKLTV<br>DKSRWQQGNVFSCSVMHEALHNHYTQKSLSLSPGK | SEQ ID NO: 753<br>QAVVTQEPSLTVSPGG<br>TVTLTCGSSTGAVTTG<br>HYANWVQQKPGQAPRG<br>LIGGTSNRAPGVPARF<br>SGSLLGGKAALTISGA<br>QPEDEAEYYCALWYSN<br>RWVFGGGTKLTVLGQP<br>KAAPSVTLFPPSSEEL<br>QANKATLVCLISDFYP<br>GAVTVAWKADSSPVKA<br>GVETTTPSKQSNNKYA<br>ASSYLSLTPEQWKSHR<br>SYSCQVTHEGSTVEKT<br>VAPTECS |
| 183<br>hCD4<br>D1.22 Fc<br>AAS + SAV + R/<br>huSP34.3.13<br>AAS + W | SEQ ID NO: 755<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGSDKTHTCPPCPAPEAAGGPSVFLF<br>PPKPKDTLMISRTPEVTCVVVDVSHEDPEVK<br>FNWYVDGVEVHNAKTKPREEQYNSTYRVVSV<br>LTVLHQDWLNGKEYKCKVSNKALPASIEKTI<br>SKAKGQPREPQVYTLPPSREEMTKNQVSLSC<br>AVKGFYPSDIAVEWESNGQPENNYKTTPPVL<br>DSDGSFFLVSKLTVDKSRWQQGNVFSCSVMH<br>EALHNRYTQKSLSLSPGK | SEQ ID NO: 757<br>EVQLVESGGGLVQPGGSLRLSCAASGFTFNTYAMN<br>WVRQAPGKGLEWVGRIRSKYNNYATYYADSVKGRF<br>TISRDDSKNSLYLQMNSLRTEDTAVYYCVRHGNFG<br>HSYVSWFAYWGQGTLVTVSSASTKGPSVFPLAPSS<br>KSTSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAGG<br>PSVFLFPPKPKDTLMISRTPEVTCVVVDVSHEDPE<br>VKFNWYVDGVEVHNAKTKPREEQYNSTYRVVSVLT<br>VLHQDWLNGKEYKCKVSNKALPASIEKTISKAKGQ<br>PREPQVYTLPPSREEMTKNQVSLWCLVKGFYPSDI<br>AVEWESNGQPENNYKTTPPVLDSDGSFFLYSKLTV<br>DKSRWQQGNVFSCSVMHEALHNHYTQKSLSLSPGK | SEQ ID NO: 753<br>QAVVTQEPSLTVSPGG<br>TVTLTCGSSTGAVTTG<br>HYANWVQQKPGQAPRG<br>LIGGTSNRAPGVPARF<br>SGSLLGGKAALTISGA<br>QPEDEAEYYCALWYSN<br>RWVFGGGTKLTVLGQP<br>KAAPSVTLFPPSSEEL<br>QANKATLVCLISDFYP<br>GAVTVAWKADSSPVKA<br>GVETTTPSKQSNNKYA<br>ASSYLSLTPEQWKSHR<br>SYSCQVTHEGSTVEKT<br>VAPTECS |
| 184<br>hCD4<br>D1.22 Fc<br>AAS + SAV/<br>huSP34.3.13<br>AAS + W | SEQ ID NO: 758<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGSDKTHTCPPCPAPEAAGGPSVFLF<br>PPKPKDTLMISRTPEVTCVVVDVSHEDPEVK<br>FNWYVDGVEVHNAKTKPREEQYNSTYRVVSV<br>LTVLHQDWLNGKEYKCKVSNKALPASIEKTI<br>SKAKGQPREPQVYTLPPSREEMTKNQVSLSC<br>AVKGFYPSDIAVEWESNGQPENNYKTTPPVL<br>DSDGSFFLVSKLTVDKSRWQQGNVFSCSVMH<br>EALHNHYTQKSLSLSPGK | SEQ ID NO: 757<br>EVQLVESGGGLVQPGGSLRLSCAASGFTFNTYAMN<br>WVRQAPGKGLEWVGRIRSKYNNYATYYADSVKGRF<br>TISRDDSKNSLYLQMNSLRTEDTAVYYCVRHGNFG<br>HSYVSWFAYWGQGTLVTVSSASTKGPSVFPLAPSS<br>KSTSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAGG<br>PSVFLFPPKPKDTLMISRTPEVTOVVVDVSHEDPE<br>VKFNWYVDGVEVHNAKTKPREEQYNSTYRVVSVLT<br>VLHQDWLNGKEYKCKVSNKALPASIEKTISKAKGQ<br>PREPQVYTLPPSREEMTKNQVSLWCLVKGFYPSDI<br>AVEWESNGQPENNYKTTPPVLDSDGSFFLYSKLTV<br>DKSRWQQGNVFSCSVMHEALHNHYTQKSLSLSPGK | SEQ ID NO: 753<br>QAVVTQEPSLTVSPGG<br>TVTLTCGSSTGAVTTG<br>HYANWVQQKPGQAPRG<br>LIGGTSNRAPGVPARF<br>SGSLLGGKAALTISGA<br>QPEDEAEYYCALWYSN<br>RWVFGGGTKLTVLGQP<br>KAAPSVTLFPPSSEEL<br>QANKATLVCLISDFYP<br>GAVTVAWKADSSPVKA<br>GVETTTPSKQSNNKYA<br>ASSYLSLTPEQWKSHR<br>SYSCQVTHEGSTVEKT<br>VAPTECS |
| 185<br>hCD4<br>D1.22 Fc<br>AAS + SAV + YTE/<br>huSP34.3.13<br>AAS + W + YTE | SEQ ID NO: 759<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGSDKTHTCPPCPAPEAAGGPSVFLF<br>PPKPKDTLYITREPEVTCVVVDVSHEDPEVK<br>FNWYVDGVEVHNAKTKPREEQYNSTYRVVSV<br>LTVLHQDWLNGKEYKCKVSNKALPASIEKTI<br>SKAKGQPREPQVYTLPPSREEMTKNQVSLSC<br>AVKGFYPSDIAVEWESNGQPENNYKTTPPVL<br>DSDGSFFLVSKLTVDKSRWQQGNVFSCSVMH<br>EALHNRYTQKSLSLSPGK | SEQ ID NO: 756<br>EVQLVESGGGLVQPGGSLRLSCAASGFTFNTYAMN<br>WVRQAPGKGLEWVGRIRSKYNNYATYYADSVKGRF<br>TISRDDSKNSLYLQMNSLRTEDTAVYYCVRHGNFG<br>HSYVSWFAYWGQGTLVTVSSASTKGPSVFPLAPSS<br>KSTSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAGG<br>PSVFLFPPKPKDTLYITREPEVTCVVVDVSHEDPE<br>VKFNWYVDGVEVHNAKTKPREEQYNSTYRVVSVLT<br>VLHQDWLNGKEYKCKVSNKALPASIEKTISKAKGQ<br>PREPQVYTLPPSREEMTKNQVSLWCLVKGFYPSDI<br>AVEWESNGQPENNYKTTPPVLDSDGSFFLYSKLTV<br>DKSRWQQGNVFSCSVMHEALHNHYTQKSLSLSPGK | SEQ ID NO: 753<br>QAVVTQEPSLTVSPGG<br>TVTLTCGSSTGAVTTG<br>HYANWVQQKPGQAPRG<br>LIGGTSNRAPGVPARF<br>SGSLLGGKAALTISGA<br>QPEDEAEYYCALWYSN<br>RWVFGGGTKLTVLGQP<br>KAAPSVTLFPPSSEEL<br>QANKATLVCLISDFYP<br>GAVTVAWKADSSPVKA<br>GVETTTPSKQSNNKYA<br>ASSYLSLTPEQWKSHR<br>SYSCQVTHEGSTVEKT<br>VAPTECS |
| 186<br>CD4<br>D1.22 Fc<br>AAS + W/<br>huSP34.1.3<br>AAS + SAV + R | SEQ ID NO: 754<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGSDKTHTCPPCPAPEAAGGPSVFLF<br>PPKPKDTLMISRTPEVTCVVVDVSHEDPEVK<br>FNWYVDGVEVHNAKTKPREEQYNSTYRVVSV<br>LTVLHQDWLNGKEYKCKVSNKALPASIEKTI<br>SKAKGQPREPQVYTLPPSREEMTKNQVSLWC<br>LVKGFYPSDIAVEWESNGQPENNYKTTPPVL | SEQ ID NO: 760<br>EVQLVESGGGLVQPGGSLRLSCAASGFTFNTYAMN<br>WVRQAPGKGLEWVGRIRSKYNNYATYYAASVKGRF<br>TISRDDSKNSLYLQMNSLKTEDTAMYYCVRHGNFG<br>NSYVSWFAYWGQGTLVTVSSASTKGPSVFPLAPSS<br>KSTSGGTAALGCLVKDYFPEPVTVSWNSGALTSGV<br>HTFPAVLQSSGLYSLSSVVTVPSSSLGTQTYICNV<br>NHKPSNTKVDKKVEPKSCDKTHTCPPCPAPEAAGG<br>PSVFLFPPKPKDTLMISRTPEVICVVVDVSHEDPE<br>VKFNWYVDGVEVHNAKTKPREEQYNSTYRVVSVLT | SEQ ID NO: 761<br>QAVVTQEPSLTVSPGG<br>TVTLTCGSSTGAVTTG<br>HYANWVQQKPGQAPRG<br>LIGGTNKRAPWTPARF<br>SGSLLGGKAALTLSGA<br>QPEDEAEYYCALWYSN<br>LWVFGGGTKLTVLGQP<br>KAAPSVTLFPPSSEEL<br>QANKATLVCLISDFYP |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| | DSDGSFFLYSKLTVDKSRWQQGNVFSCSVMH EALHNHYTQKSLSLSPGK | VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | GAVTVAWKADSSPVKA GVETTTPSKQSNNKYA ASSYLSLTPEQWKSHR SYSCQVTHEGSTVEKT VAPTECS |
| 187 hCD4 D1.22 Fc AAS + W + LS/ huSP34.1.3 AAS + SAV + R | SEQ ID NO: 762 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGSDKTHTCPPCPAPEAAGGPSVFLF PPKPKDTLMISRTPEVTCVVVDVSHEDPEVK FNWYVDGVEVHNAKTKPREEQYNSTYRVVS LTVLHQDWLNGKEYKCKVSNKALPASIEKTI SKAKGQPREPQVYTLPPSREEMTKNQVSLWC LVKGFYPSDIAVEWESNGQPENNYKTTPPVL DSDGSFFLYSKLTVDKSRWQQGNVFSCSVLH EALHSHYTQKSLSLSPGK | SEQ ID NO: 760 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 761 QAVVTQEPSLTVSPGG TVTLTCGSSTGAVTTG HYANWVQQKPGQAPRG LIGGTNKRAPWTPARF SGSLLGGKAALTLSGA QPEDEAEYYCALWYSN LWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 190 hCD4 D1.22 (tandem) Fc AAS + W + YTE/ huSP34.39.13 AAS + SAV + R | SEQ ID NO: 764 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLYITREPEVTCVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLWCLVKGFYPSDIAVEWESNGQP ENNYKTTPPVLDSDGSFFLYSKLTVDKSRWQ QGNVFSCSVMHEALHNRYTQKSLSLSPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 191 hCD4 D1.22 (tandem) Fc AAS + W/ huSP34.39.13 AAS + SAV + R | SEQ ID NO: 765 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLMISRTPEVICVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLWCLVKGFYPSDIAVEWESNGQP ENNYKTTPPVLDSDGSFFLYSKLTVDKSRWQ QGNVFSCSVMHEALHNRYTQKSLSLSPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 192 hCD4 D1.22 (tandem) Fc AAS + SAV + R/ huSP34.3.13 AAS + W + YTE | SEQ ID NO: 766 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLYITREPEVTCVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLSCAVKGFYPSDIAVEWESNGQP ENNYKTTPPVLDSDGSFFLVSKLTVDKSRWQ QGNVFSCSVMHEALHNRYTQKSLSLSPGK | SEQ ID NO: 767 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLYITREPEVTCVVVDVSHEDPE VKFNWYVDGVEVHNAKTKPREEQYNSTYRVVSVLT VLHQDWLNGKEYKCKVSN VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 193 hCD4 D1.22 (tandem) Fc AAS + SAV + | SEQ ID NO: 766 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ | SEQ ID NO: 768 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS | SEQ ID NO: 753 QAVVTQEPSLTVSPGG TVTLTCGSSTGAVTTG HYANWVQQKPGQAPRG LIGGTSNRAPGVPARF |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| R/ huSP34.3.13 AAS + W | KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLMISRTPEVICVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLSCAVKGFYPSDIAVEWESNGQP ENNYKTTPPVLDSDGSFFLVSKLTVDKSRWQ QGNVFSCSVMHEALHNRYTQKSLSLSPGK | KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 194 hCD4 D1.22 (tandem) Fc AAS + SAV/ huSP34.3.13 AAS + W | SEQ ID NO: 769 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLMISRTPEVICVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLSCAVKGFYPSDIAVEWESNGQP ENNYKTTPPVLDSDGSFFLVSKLTVDKSRWQ QGNVFSCSVMHEALHNRYTQKSLSLSPGK | SEQ ID NO: 768 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 195 hCD4 D1.22 (tandem) Fc AAS + SAV + YTE/ huSP34.3.13 AAS + W + YTE | SEQ ID NO: 770 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLYITREPEVTCVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLSCAVKGFYPSDIAVEWESNGQP ENNYKTTPPVLDSDGSFFLVSKLTVDKSRWQ QGNVFSCSVMHEALHNHYTQKSLSLSPGK | SEQ ID NO: 767 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLYITREPEVTCVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 196 hCD4 D1.22 (tandem) Fc AAS + W/ huSP34.1.3 AAS + SAV + R | SEQ ID NO: 765 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLMISRTPEVICVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLWCLVKGFYPSDIAVEWESNGQP ENNYKTTPPVLDSDGSFFLYSKLTVDKSRWQ QGNVFSCSVMHEALHNRYTQKSLSLSPGK | SEQ ID NO: 771 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLYSKLTV DKSRWQQGNVFSCSVMHEALHNRYTQKSLSLSPGK | SEQ ID NO: 761 QAVVTQEPSLTVSPGG TVTLTCGSSTGAVTTG HYANWVQQKPGQAPRG LIGGTNKRAPWTARF SGSLLGGKAALTLSGA QPEDEAEYYCALWYSN LWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 197 hCD4 D1.22 (tandem) Fc AAS + W + LS/ huSP34.1.3 AAS + SAV + R | SEQ ID NO: 772 KKVVYGKKGDTVELTCTASQKKNIQFHWKNS NQIKILGNQGSFLTKGPSKLNDRVDSRRSLW DQGNFPLIIKNLKPEDSDTYICEVEDQKEEV QLVVVGGGGSGKKVVYGKKGDTVELTCTASQ KKNIQFHWKNSNQIKILGNQGSFLTKGPSKL NDRVDSRRSLWDQGNFPLIIKNLKPEDSDTY ICEVEDQKEEVQLVVVGGSDKTHTCPPCPAP EAAGGPSVFLFPPKPKDTLMISRTPEVICVV VDVSHEDPEVKFNWYVDGVEVHNAKTKPREE QYNSTYRVVSVLTVLHQDWLNGKEYKCKVSN KALPASIEKTISKAKGQPREPQVYTLPPSRE EMTKNQVSLWCLVKGFYPSDIAVEWESNGQP ENNYKTTPPVLDSDGSFFLYSKLTVDKSRWQ QGNVFSCSVLHEALHSHYTQKSLSLSPGK | SEQ ID NO: 771 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLYSKLTV DKSRWQQGNVFSCSVMHEALHNRYTQKSLSLSPGK | SEQ ID NO: 761 QAVVTQEPSLTVSPGG TVTLTCGSSTGAVTTG HYANWVQQKPGQAPRG LIGGTNKRAPWTARF SGSLLGGKAALTLSGA QPEDEAEYYCALWYSN LWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 198 hCD4-D1.22 (tandem) Fc AAS + W + LS/ huSP34.1.3scFv AAS + SAV R | SEQ ID NO: 772<br>KKVVYGKKGDTVELTCTASQKKNIQFHWKNS<br>NQIKILGNQGSFLTKGPSKLNDRVDSRRSLW<br>DQGNFPLIIKNLKPEDSDTYICEVEDQKEEV<br>QLVVVGGGGSGKKVVYGKKGDTVELTCTASQ<br>KKNIQFHWKNSNQIKILGNQGSFLTKGPSKL<br>NDRVDSRRSLWDQGNFPLIIKNLKPEDSDTY<br>ICEVEDQKEEVQLVVVGGSDKTHTCPPCPAP<br>EAAGGPSVFLFPPKPKDTLMISRTPEVICVV<br>VDVSHEDPEVKFNWYVDGVEVHNAKTKPREE<br>QYNSTYRVVSVLTVLHQDWLNGKEYKCKVSN<br>KALPASIEKTISKAKGQPREPQVYTLPPSRE<br>EMTKNQVSLWCLVKGFYPSDIAVEWESNGQP<br>ENNYKTTPPVLDSDGSFFLYSKLTVDKSRWQ<br>QGNVFSCSVLHEALHSHYTQKSLSLSPGK | SEQ ID NO: 773<br>EVQLVESGGGLVQPGGSLRLSCAASGFTFNTYAMN<br>WVRQAPGKGLEWVGRIRSKYNNYATYYAASVKGRF<br>TISRDDSKNSLYLQMNSLKTEDTAMYYCVRHGNFG<br>NSYVSWFAYWGQGTLVTVSSGGGGSGGGGSGGGGS<br>GGGGSQAVVTQEPSLTVSPGGTVTLTCGSSTGAVT<br>TGHYANWVQQKPGQAPRGLIGGTNKRAPWTPARFS<br>GSLLGGKAALTLSGAQPEDEAEYYCALWYSNLWVF<br>GGGTKLTVLEPKSSDKTHTCPPCPAPEAAGGPSVF<br>LFPPKPKDTLMISRTPEVTCVVVDVSHEDPEVKFN<br>WYVDGVEVHNAKTKPREEQYNSTYRVVSVLTVLHQ<br>DWLNGKEYKCKVSNKALPASIEKTISKAKGQPREP<br>QVYTLPPSREEMTKNQVSLSCAVKGFYPSDIAVEW<br>ESNGQPENNYKTTPPVLDSDGSFFLVSKLTVDKSR<br>WQQGNVFSCSVMHEALHNRYTQKSLSLSPGK | |
| 199 hCD4-D1.22 (bivalent) AAS + W + LS/ huSP34.1.3scFv AAS + SAV + R | SEQ ID NO: 774<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNRYTQKSLSLSPGK | SEQ ID NO: 775<br>KKVVYGKKGDTVELTCTASQKKNIQFHWKNSNQIK<br>ILGNQGSFLTKGPSKLNDRVDSRRSLWDQGNFPLI<br>IKNLKPEDSDTYICEVEDQKEEVQLVVVGGGGSGS<br>SASTKGPSVFPLAPSSKSTSGGTAALGCLVKDYFP<br>EPVTVSWNSGALTSGVHTFPAVLQSSGLYSLSSVV<br>TVPSSSLGTQTYICNVNHKPSNTKVDKKVEPKSCD<br>KTHTCPPCPAPEAAGGPSVFLFPPKPKDTLMISRT<br>PEVTCVVVDVSHEDPEVKFNWYVDGVEVHNAKTKP<br>REEQYNSTYRVVSVLTVLHQDWLNGKEYKCKVSNK<br>ALPASIEKTISKAKGQPREPQVYTLPPSREEMTKN<br>QVSLWCLVKGFYPSDIAVEWESNGQPENNYKTTPP<br>VLDSDGSFFLYSKLTVDKSRWQQGNVFSCSVLHEA<br>LHSHYTQKSLSLSPGK | SEQ ID NO: 776<br>KKVVYGKKGDTVELTC<br>TASQKKNIQFHWKNSN<br>QIKILGNQGSFLTKGP<br>SKLNDRVDSRRSLWDQ<br>GNFPLIIKNLKPEDSD<br>TYICEVEDQKEEVQLV<br>VVGGGGSGKRTVAAPS<br>VFIFPPSDEQLKSGTA<br>SVVCLLNNFYPREAKV<br>QWKVDNALQSGNSQES<br>VTEQDSKDSTYSLSST<br>LTLSKADYEKHKVYAC<br>EVTHQGLSSPVTKSFN<br>RGEC |
| 200 hCD4 D1.22 (bivalent) AAS + SAV + R/ huSP34.3.13scFv AAS + W + YTE | SEQ ID NO: 777<br>EVQLVESGGGLVQPGGSLRLSCAASGFTFNT<br>YAMNWVRQAPGKGLEWVGRIRSKYNNYATYY<br>ADSVKGRFTISRDDSKNSLYLQMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLYITREPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 778<br>KKVVYGKKGDTVELTCTASQKKNIQFHWKNSNQIK<br>ILGNQGSFLTKGPSKLNDRVDSRRSLWDQGNFPLI<br>IKNLKPEDSDTYICEVEDQKEEVQLVVVGGGGSGS<br>SASTKGPSVFPLAPSSKSTSGGTAALGCLVKDYFP<br>EPVTVSWNSGALTSGVHTFPAVLQSSGLYSLSSVV<br>TVPSSSLGTQTYICNVNHKPSNTKVDKKVEPKSCD<br>KTHTCPPCPAPEAAGGPSVFLFPPKPKDTLMISRT<br>PEVTCVVVDVSHEDPEVKFNWYVDGVEVHNAKTKP<br>REEQYNSTYRVVSVLTVLHQDWLNGKEYKCKVSNK<br>ALPASIEKTISKAKGQPREPQVYTLPPSREEMTKN<br>QVSLSCAVKGFYPSDIAVEWESNGQPENNYKTTPP<br>VSVLTVLHQDWLNGKEYKCKVSNKALPASIE<br>VLDSDGSFFLVSKLTVDKSRWQQGNVFSCSVMHEA<br>LHNRYTQKSLSLSPGK | SEQ ID NO: 776<br>KKVVYGKKGDTVELTC<br>TASQKKNIQFHWKNSN<br>QIKILGNQGSFLTKGP<br>SKLNDRVDSRRSLWDQ<br>GNFPLIIKNLKPEDSD<br>TYICEVEDQKEEVQLV<br>VVGGGGSGKRTVAAPS<br>VFIFPPSDEQLKSGTA<br>SVVCLLNNFYPREAKV<br>QWKVDNALQSGNSQES<br>VTEQDSKDSTYSLSST<br>LTLSKADYEKHKVYAC<br>EVTHQGLSSPVTKSFN<br>RGEC |
| 201 hCD4 D1.22 (bivalent) AAS + SAV + R/ huSP34.3.13scFv AAS + W | SEQ ID NO: 779<br>EVQLVESGGGLVQPGGSLRLSCAASGFTFNT<br>YAMNWVRQAPGKGLEWVGRIRSKYNNYATYY<br>ADSVKGRFTISRDDSKNSLYLQMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 778<br>KKVVYGKKGDTVELTCTASQKKNIQFHWKNSNQIK<br>ILGNQGSFLTKGPSKLNDRVDSRRSLWDQGNFPLI<br>IKNLKPEDSDTYICEVEDQKEEVQLVVVGGGGSGS<br>SASTKGPSVFPLAPSSKSTSGGTAALGCLVKDYFP<br>EPVTVSWNSGALTSGVHTFPAVLQSSGLYSLSSVV<br>TVPSSSLGTQTYICNVNHKPSNTKVDKKVEPKSCD<br>KTHTCPPCPAPEAAGGPSVFLFPPKPKDTLMISRT<br>PEVTCVVVDVSHEDPEVKFNWYVDGVEVHNAKTKP<br>REEQYNSTYRVVSVLTVLHQDWLNGKEYKCKVSNK<br>ALPASIEKTISKAKGQPREPQVYTLPPSREEMTKN<br>QVSLSCAVKGFYPSDIAVEWESNGQPENNYKTTPP<br>VLDSDGSFFLVSKLTVDKSRWQQGNVFSCSVMHEA<br>LHNRYTQKSLSLSPGK | SEQ ID NO: 776<br>KKVVYGKKGDTVELTC<br>TASQKKNIQFHWKNSN<br>QIKILGNQGSFLTKGP<br>SKLNDRVDSRRSLWDQ<br>GNFPLIIKNLKPEDSD<br>TYICEVEDQKEEVQLV<br>VVGGGGSGKRTVAAPS<br>VFIFPPSDEQLKSGTA<br>SVVCLLNNFYPREAKV<br>QWKVDNALQSGNSQES<br>VTEQDSKDSTYSLSST<br>LTLSKADYEKHKVYAC<br>EVTHQGLSSPVTKSFN<br>RGEC |
| 202 hCD4 D1.22 (bivalent) AAS + SAV/ | SEQ ID NO: 779<br>EVQLVESGGGLVQPGGSLRLSCAASGFTFNT<br>YAMNWVRQAPGKGLEWVGRIRSKYNNYATYY<br>ADSVKGRFTISRDDSKNSLYLQMNSLRTEDT<br>AVYYCVRHGNFGHSYVSWFAYWGQGTLVTVS | SEQ ID NO: 780<br>KKVVYGKKGDTVELTCTASQKKNIQFHWKNSNQIK<br>ILGNQGSFLTKGPSKLNDRVDSRRSLWDQGNFPLI<br>IKNLKPEDSDTYICEVEDQKEEVQLVVVGGGGSGS<br>SASTKGPSVFPLAPSSKSTSGGTAALGCLVKDYFP | SEQ ID NO: 776<br>KKVVYGKKGDTVELTC<br>TASQKKNIQFHWKNSN<br>QIKILGNQGSFLTKGP<br>SKLNDRVDSRRSLWDQ |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| huSP34.3.13scFv AAS + W | SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | EPVTVSWNSGALTSGVHTFPAVLQSSGLYSLSSVV TVPSSSLGTQTYICNVNHKPSNTKVDKKVEPKSCD KTHTCPPCPAPEAAGGPSVFLFPPKPKDTLMISRT PEVTCVVVDVSHEDPEVKFNWYVDGVEVHNAKTKP REEQYNSTYRVVSVLTVLHQDWLNGKEYKCKVSNK ALPASIEKTISKAKGQPREPQVYTLPPSREEMTKN QVSLSCAVKGFYPSDIAVEWESNGQPENNYKTTPP VLDSDGSFFLVSKLTVDKSRWQQGNVFSCSVMHEA LHNHYTQKSLSLSPGK | GNFPLIIKNLKPEDSD TYICEVEDQKEEVQLV VVGGGGSGKRTVAAPS VFIFPPPSDEQLKSGTA SVVCLLNNFYPREAKV QWKVDNALQSGNSQES VTEQDSKDSTYSLSST LTLSKADYEKHKVYAC EVTHQGLSSPVTKSFN RGEC |
| 203 hCD4 D1.22 (bivalent) AAS + SAV + YTE/ huSP34.3.13scFv AAS + W + YTE | SEQ ID NO: 777 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 781 KKVVYGKKGDTVELTCTASQKKNIQFHWKNSNQIK ILGNQGSFLTKGPSKLNDRVDSRRSLWDQGNFPLI IKNLKPEDSDTYICEVEDQKEEVQLVVVGGGGSGS SASTKGPSVFPLAPSSKSTSGGTAALGCLVKDYFP EPVTVSWNSGALTSGVHTFPAVLQSSGLYSLSSVV TVPSSSLGTQTYICNVNHKPSNTKVDKKVEPKSCD KTHTCPPCPAPEAAGGPSVFLFPPKPKDTLYITRE PEVTCVVVDVSHEDPEVKFNWYVDGVEVHNAKTKP REEQYNSTYRVVSVLTVLHQDWLNGKEYKCKVSNK ALPASIEKTISKAKGQPREPQVYTLPPSREEMTKN QVSLSCAVKGFYPSDIAVEWESNGQPENNYKTTPP VLDSDGSFFLVSKLTVDKSRWQQGNVFSCSVMHEA LHNHYTQKSLSLSPGK | SEQ ID NO: 776 KKVVYGKKGDTVELTC TASQKKNIQFHWKNSN QIKILGNQGSFLTKGP SKLNDRVDSRRSLWDQ GNFPLIIKNLKPEDSD TYICEVEDQKEEVQLV VVGGGGSGKRTVAAPS VFIFPPPSDEQLKSGTA SVVCLLNNFYPREAKV QWKVDNALQSGNSQES VTEQDSKDSTYSLSST LTLSKADYEKHKVYAC EVTHQGLSSPVTKSFN RGEC |
| 204 hCD4 D1D2 Fc AAS + W + YTE/ huSP34.39.13 AAS + SAV + R | SEQ ID NO: 782 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLYITREP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW ESNGQPENNYKTTPPVLDSDGSFFLYSKLTV DKSRWQQGNVFSCSVMHEALHNHYTQKSLSL SPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVTCVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 205 hCD4 D1D2 Fc AAS + W/ huSP34.39.13 AAS + SAV + R | SEQ ID NO: 783 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW ESNGQPENNYKTTPPVLDSDGSFFLYSKLTV DKSRWQQGNVFSCSVMHEALHNHYTQKSLSL SPGK | SEQ ID NO: 752 EVQLVESGGGLVQPGGSLRLSCAASGFTFNTYAMN WVRQAPGKGLEWVGRIRSKYNNYATYYADSVKSRF TISRDDSKNSLYLEMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 206 hCD4 D1D2 Fc AAS + SAV + R/ huSP34.3.13 AAS + W + YTE | SEQ ID NO: 784 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW | SEQ ID NO: 785 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLYITREPEVTQVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| | ESNGQPENNYKTTPPVLDSDGSFFLVSKLTV DKSRWQQGNVFSCSVMHEALHNRYTQKSLSL SPGK | AVEWESNGQPENNYKTTPPVLDSDGSFFLYSKLTV DKSRWQQGNVFSCSVMHEALHNHYTQKSLSLSPGK | ASSYLSLTPEQWKSHR SYSCQVTHEGSTVEKT VAPTECS |
| 207 hCD4 D1D2 Fc AAS + SAV + R/ huSP34.3.13 AAS + W | SEQ ID NO: 784 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLSCAVKGFYPSDIAVEW ESNGQPENNYKTTPPVLDSDGSFFLVSKLTV DKSRWQQGNVFSCSVMHEALHNRYTQKSLSL SPGK | SEQ ID NO: 786 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVTCVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 208 hCD4 D1D2 Fc AAS + SAV/ huSP34.3.13 AAS + W | SEQ ID NO: 787 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLSCAVKGFYPSDIAVEW ESNGQPENNYKTTPPVLDSDGSFFLVSKLTV DKSRWQQGNVFSCSVMHEALHNHYTQKSLSL SPGK | SEQ ID NO: 786 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVICVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 209 hCD4 D1D2 Fc AAS + SAV + YTE/ huSP34.3.13 AAS + W + YTE | SEQ ID NO: 788 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLYITREP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLSCAVKGFYPSDIAVEW ESNGQPENNYKTTPPVLDSDGSFFLVSKLTV DKSRWQQGNVFSCSVMHEALHNHYTQKSLSL SPGK | SEQ ID NO: 785 EVQLVESGGGLVQPGGSLRLSCAASGFTFNTYAMN WVRQAPGKGLEWVGRIRSKYNNYATYYADSVKGRF TISRDDSKNSLYLQMNSLRTEDTAVYYCVRHGNFG HSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLYITREPTOVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLWCLVKGFYPSDI AVEWESNGQPENNYKTTPPVLDSDGSFFLYSKLTV DKSRWQQGNVFSCSVMHEALHNHYTQKSLSLSPGK | SEQ ID NO: 753 QAVVTQEPSLTVSPGG TVTLTCGSSTGAVTTG HYANWVQQKPGQAPRG LIGGTSNRAPGVPARF SGSLLGGKAALTISGA QPEDEAEYYCALWYSN RWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 210 CD4 D1D2 Fc AAS W/ huSP34.1.3 AAS + SAV + R | SEQ ID NO: 783 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW ESNGQPENNYKTTPPVLDSDGSFFLYSKLTV DKSRWQQGNVFSCSVMHEALHNRYTQKSLSL SPGK | SEQ ID NO: 789 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSASTKGPSVFPLAPSS KSTSGGTAALGCLVKDYFPEPVTVSWNSGALTSGV HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVTOVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLYSKLTV DKSRWQQGNVFSCSVMHEALHNHYTQKSLSLSPGK | SEQ ID NO: 761 QAVVTQEPSLTVSPGG TVTLTCGSSTGAVTTG HYANWVQQKPGQAPRG LIGGTNKRAPWTPARF SGSLLGGKAALTLSGA QPEDEAEYYCALWYSN LWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 211 hCD4-D1D2 Fc AAS + W + LS/ huSP34.1.3 | SEQ ID NO: 790 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG | SEQ ID NO: 789 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSASTKGPSVFPLAPSS KSTSGGTAALGCLVKDYFPEPVTVSWNSGALTSGV | SEQ ID NO: 761 QAVVTQEPSLTVSPGG TVTLTCGSSTGAVTTG HYANWVQQKPGQAPRG LIGGTNKRAPWTPARF SGSLLGGKAALTLSGA |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| AAS + SAV + R | TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW ESNGQPENNYKTTPPVLDSDGSFFLYSKLTV DKSRWQQGNVFSCSVLHEALHSHYTQKSLSL SPGK | HTFPAVLQSSGLYSLSSVVTVPSSSLGTQTYICNV NHKPSNTKVDKKVEPKSCDKTHTCPPCPAPEAAGG PSVFLFPPKPKDTLMISRTPEVTCVVVDVSHEDPE VKFNWYVDGVEVHNAKTKPREEQYNSTYRVVSVLT VLHQDWLNGKEYKCKVSNKALPASIEKTISKAKGQ PREPQVYTLPPSREEMTKNQVSLSCAVKGFYPSDI AVEWESNGQPENNYKTTPPVLDSDGSFFLVSKLTV DKSRWQQGNVFSCSVMHEALHNRYTQKSLSLSPGK | QPEDEAEYYCALWYSN LWVFGGGTKLTVLGQP KAAPSVTLFPPSSEEL QANKATLVCLISDFYP GAVTVAWKADSSPVKA GVETTTPSKQSNNKYA ASSYLSLTPEQWKSHR SYSCQVTHEGSTVEKT VAPTECS |
| 212 hCD4- D1D2 Fc AAS + W + LS/ huSP34.1.3scFv AAS + SAV + R | SEQ ID NO: 790 KKVVLGKKGDTVELTCTASQKKSIQFHWKNS NQIKILGNQGSFLTKGPSKLNDRADSRRSLW DQGNFPLIIKNLKIEDSDTYICEVEDQKEEV QLLVFGLTANSDTHLLQGQSLTLTLESPPGS SPSVQCRSPRGKNIQGGKTLSVSQLELQDSG TWTCTVLQNQKKVEFKIDIVVLAGSDKTHTC PPCPAPEAAGGPSVFLFPPKPKDTLMISRTP EVTCVVVDVSHEDPEVKFNWYVDGVEVHNAK TKPREEQYNSTYRVVSVLTVLHQDWLNGKEY KCKVSNKALPASIEKTISKAKGQPREPQVYT LPPSREEMTKNQVSLWCLVKGFYPSDIAVEW ESNGQPENNYKTTPPVLDSDGSFFLYSKLTV DKSRWQQGNVFSCSVLHEALHSHYTQKSLSL SPGK | SEQ ID NO: 791 EVQLVESGGGLVQPGGSLRLSCAASGFTFNTYAMN WVRQAPGKGLEWVGRIRSKYNNYATYYAASVKGRF TISRDDSKNSLYLQMNSLKTEDTAMYYCVRHGNFG NSYVSWFAYWGQGTLVTVSSGGGGSGGGGSGGGGS GGGGSQAVVTQEPSLTVSPGGTVTLTCGSSTGAVT TGHYANWVQQKPGQAPRGLIGGTNKRAPWTPARFS GSLLGGKAALTLSGAQPEDEAEYYCALWYSNLWVF GGGTKLTVLEPKSSDKTHTCPPCPAPEAAGGPSVF LFPPKPKDTLMISRTPEVTCVVVDVSHEDPEVKFN WYVDGVEVHNAKTKPREEQYNSTYRVVSVLTVLHQ DWLNGKEYKCKVSNKALPASIEKTISKAKGQPREP QVYTLPPSREEMTKNQVSLSCAVKGFYPSDIAVEW ESNGQPENNYKTTPPVLDSDGSFFLVSKLTVDKSR WQQGNVFSCSVMHEALHNRYTQKSLSLSPGK | |
| 213 hCD4- D1D2 (bivalent AAS + W + LS/ husp34.1.3scFv AAS + SAV + R | SEQ ID NO: 792 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 793 KKVVLGKKGDTVELTCTASQKKSIQFHWKNSNQIK ILGNQGSFLTKGPSKLNDRADSRRSLWDQGNFPLI IKNLKIEDSDTYICEVEDQKEEVQLLVFGLTANSD THLLQGQSLTLTLESPPGSSPSVQCRSPRGKNIQG GKTLSVSQLELQDSGTWTCTVLQNQKKVEFKIDIV VLAGGGGSGKRTVAAPSVFIFPPSDEQLKSGTASV VCLLNNFYPREAKVQWKVDNALQSGNSQESVTEQD SKDSTYSLSSTLTLSKADYEKHKVYACEVTHQGLS SPVTKSFNRGEC [the VH-Fc sequence] KKVVLGKKGDTVELTCTASQKKSIQFHWKNSNQIK ILGNQGSFLTKGPSKLNDRADSRRSLWDQGNFPLI IKNLKIEDSDTYICEVEDQKEEVQLLVFGLTANSD THLLQGQSLTLTLESPPGSSPSVQCRSPRGKNIQG GKTLSVSQLELQDSGTWTCTVLQNQKKVEFKIDIV VLAGGGGSGSSASTKGPSVFPLAPSSKSTSGGTAA LGCLVKDYFPEPVTVSWNSGALTSGVHTFPAVLQS SGLYSLSSVVTVPSSSLGTQTYICNVNHKPSNTKVD KKVEPKSCDKTHTCPPCPAPEAAGGPSVFLFPPKP KDTLMISRTPEVTCVVVDVSHEDPEVKFNWYVDGV EVHNAKTKPREEQYNSTYRVVSVLTVLHQDWLNGK EYKCKVSNKALPASIEKTISKAKGQPREPQVYTLP PSREEMTKNQVSLSCAVKGFYPSDIAVEWESNGQP ENNYKTTPPVLDSDGSFFLVSKLTVDKSRWQQGNV FSCSVLHEALHSHYTQKSLSLSPGK | SEQ ID NO: 794 KKVVLGKKGDTVELTC TASQKKSIQFHWKNSN QIKILGNQGSFLTKGP SKLNDRADSRRSLWDQ GNFPLIIKNLKIEDSD TYICEVEDQKEEVQLL VFGLTANSDTHLLQGQ SLTLTLESPPGSSPSV QCRSPRGKNIQGGKTL SVSQLELQDSGTWTCT VLQNQKKVEFKIDIVV LAGGGGSGKRTVAAPSV FIFPPSDEQLKSGTAS VVCLLNNFYPREAKVQ WKVDNALQSGNSQESV TEQDSKDSTYSLSSTL TLSKADYEKHKVYACE VTHQGLSSPVTKSFNR GEC |
| 214 hCD4 D1D2 (bivalent) AAS + SAV + R/ huSP34.3.13scFv AAS + W + YTE | SEQ ID NO: 795 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNSRAPGVPARFSGSLLGGK AALTISGAQPEDEAEYYCALWYSNRWVFGGG GLYSLSSVVTVPSSSLGTQTYICNVNHKPSNTKVD TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 796 KKVVLGKKGDTVELTCTASQKKSIQFHWKNSNQIK ILGNQGSFLTKGPSKLNDRADSRRSLWDQGNFPLI IKNLKIEDSDTYICEVEDQKEEVQLLVFGLTANSD THLLQGQSLTLTLESPPGSSPSVQCRSPRGKNIQG GKTLSVSQLELQDSGTWTCTVLQNQKKVEFKIDIV VLAGGGGSGSSASTKGPSVFPLAPSSKSTSGGTAAL GCLVKDYFPEPVTVSWNSGALTSGVHTFPAVLQSS AALTISGAQPEDEAEYYCALWYSNRWVFGGG KKVEPKSCDKTHTCPPCPAPEAAGGPSVFLFPPKP KDTLMISRTPEVTCVVVDVSHEDPEVKFNWYVDGV EVHNAKTKPREEQYNSTYRVVSVLTVLHQDWLNGK EYKCKVSNKALPASIEKTISKAKGQPREPQVYTLP PSREEMTKNQVSLSCAVKGFYPSDIAVEWESNGQP ENNYKTTPPVLDSDGSFFLVSKLTVDKSRWQQGNV FSCSVMHEALHNRYTQKSLSLSPGK | SEQ ID NO: 794 KKVVLGKKGDTVELTC TASQKKSIQFHWKNSN QIKILGNQGSFLTKGP SKLNDRADSRRSLWDQ GNFPLIIKNLKIEDSD TYICEVEDQKEEVQLL VFGLTANSDTHLLQGQ SLTLTLESPPGSSPSV QCRSPRGKNIQGGKTL SVSQLELQDSGTWTCT VLQNQKKVEFKIDIVV LAGGGGSGKRTVAAPSV FIFPPSDEQLKSGTAS VVCLLNNFYPREAKVQ WKVDNALQSGNSQESV TEQDSKDSTYSLSSTL TLSKADYEKHKVYACE VTHQGLSSPVTKSFNR GEC |
| 215 hCD4 D1D2 (bivalent) AAS + SAV + R/ huSP34.3.13scFv AAS + W | SEQ ID NO: 797 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK | SEQ ID NO: 796 KKVVLGKKGDTVELTCTASQKKSIQFHWKNSNQIK ILGNQGSFLTKGPSKLNDRADSRRSLWDQGNFPLI IKNLKIEDSDTYICEVEDQKEEVQLLVFGLTANSD THLLQGQSLTLTLESPPGSSPSVQCRSPRGKNIQG GKTLSVSQLELQDSGTWTCTVLQNQKKVEFKIDIV VLAGGGGSGSSASTKGPSVFPLAPSSKSTSGGTAAL | SEQ ID NO: 794 KKVVLGKKGDTVELTC TASQKKSIQFHWKNSN QIKILGNQGSFLTKGP SKLNDRADSRRSLWDQ GNFPLIIKNLKIEDSD TYICEVEDQKEEVQLL |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| | PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | GCLVKDYFPEPVTVSWNSGALTSGVHTFPAVLQSS GLYSLSSVVTVPSSSLGTQTYICNVNHKPSNTKVD KKVEPKSCDKTHTCPPCPAPEAAGGPSVFLFPPKP KDTLMISRTPEVTCVVVDVSHEDPEVKFNWYVDGV EVHNAKTKPREEQYNSTYRVVSVLTVLHQDWLNGK EYKCKVSNKALPASIEKTISKAKGQPREPQVYTLP PSREEMTKNQVSLSCAVKGFYPSDIAVEWESNGQP ENNYKTTPPVLDSDGSFFLVSKLTVDKSRWQQGNV FSCSVMHEALHNRYTQKSLSLSPGK | VFGLTANSDTHLLQGQ SLTLTLESPPGSSPSV QCRSPRGKNIQGGKTL SVSQLELQDSGTWTCT VLQNQKKVEFKIDIVV LAGGGGSGKRTVAAPSV FIFPPSDEQLKSGTAS VVCLLNNFYPREAKVQ WKVDNALQSGNSQESV TEQDSKDSTYSLSSTL TLSKADYEKHKVYACE VTHQGLSSPVTKSFNR GEC |
| 216 hCD4 D1D2 (bivalent) AAS + SAV/ huSP34.3.13scFv AAS + W | SEQ ID NO: 797 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 798 DYFPEPVTVSWNSGALTSGVHTFPAVLQSS GLYSLSSVVTVPSSSLGTQTYICNVNHKPSNTKVD KKVEPKSCDKTHTCPPCPAPEAAGGPSVFLFPPKP KDTLMISRTPEVTCVVVDVSHEDPEVKFNWYVDGV EVHNAKTKPREEQYNSTYRVVSVLTVLHQDWLNGK EYKCKVSNKALPASIEKTISKAKGQPREPQVYTLP PSREEMTKNQVSLSCAVKGFYPSDIAVEWESNGQP ENNYKTTPPVLDSDGSFFLVSKLTVDKSRWQQGNV FSCSVMHEALHNRYTQKSLSLSPGK | SEQ ID NO: 794 KKVVLGKKGDTVELTC TASQKKSIQFHWKNSN QIKILGNQGSFLTKGP SKLNDRADSRRSLWDQ GNFPLIIKNLKIEDSD TYICEVEDQKEEVQLL VFGLTANSDTHLLQGQ SLTLTLESPPGSSPSV QCRSPRGKNIQGGKTL SVSQLELQDSGTWTCT VLQNQKKVEFKIDIVV LAGGGGSGKRTVAAPSV FIFPPSDEQLKSGTAS VVCLLNNFYPREAKVQ WKVDNALQSGNSQESV TEQDSKDSTYSLSSTL TLSKADYEKHKVYACE VTHQGLSSPVTKSFNR GEC |
| 217 hCD4 D1D2 (bivalent) AAS + SAV + YTE/ huSP34.3.13scFv AAS + W + YTE | SEQ ID NO: 795 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 799 IKNLKIEDSDTYICEVEDQKEEVQLLVFGLTANSD THLLQGQSLTLTLESPPGSSPSVQCRSPRGKNIQG GKTLSVSQLELQDSGTWTCTVLQNQKKVEFKIDIV VLAGGGSGSSASTKGPSVFPLAPSSKSTSGGTAAL GCLVKDYFPEPVTVSWNSGALTSGVHTFPAVLQSS GLYSLSSVVTVPSSSLGTQTYICNVNHKPSNTKVD KKVEPKSCDKTHTCPPCPAPEAAGGPSVFLFPPKP KDTLYITREPEVTCVVVDVSHEDPEVKFNWYVDGV EVHNAKTKPREEQYNSTYRVVSVLTVLHQDWLNGK EYKCKVSNKALPASIEKTISKAKGQPREPQVYTLP PSREEMTKNQVSLSCAVKGFYPSDIAVEWESNGQP ENNYKTTPPVLDSDGSFFLVSKLTVDKSRWQQGNV FSCSVMHEALHNHYTQKSLSLSPGK | SEQ ID NO: 794 KKVVLGKKGDTVELTC TASQKKSIQFHWKNSN QIKILGNQGSFLTKGP SKLNDRADSRRSLWDQ GNFPLIIKNLKIEDSD TYICEVEDQKEEVQLL VFGLTANSDTHLLQGQ SLTLTLESPPGSSPSV QCRSPRGKNIQGGKTL SVSQLELQDSGTWTCT VLQNQKKVEFKIDIVV LAGGGGSGKRTVAAPSV FIFPPSDEQLKSGTAS VVCLLNNFYPREAKVQ WKVDNALQSGNSQESV TEQDSKDSTYSLSSTL TLSKADYEKHKVYACE VTHQGLSSPVTKSFNR GEC |
| 218 h3BNC117.52.64 AAS + SAV + YTE/ huSP34.3.13scFv AAS + W + YTE | SEQ ID NO: 800 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 801 QVQLLQSGAAVTKPGASVRVSCEASGYNIRDYFIH WWRQAPGQGLQWVGWINPKTGQPNNPRQFQGRVSL TRHASFDFDTFSYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 219 h3BNC117.52.64 AAS + SAV + R/ huSP34.3.13scFv AAS + W + YTE | SEQ ID NO: 800 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 803 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNRYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 220 h3BNC117.52.64 AAS + SAV + R/ huSP34.3.13scFv AAS + W | SEQ ID NO: 804 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 803 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNRYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 221 h3BNC117.52.64 AAS + SAV/ huSP34.3.13scFv AAS + W | SEQ ID NO: 804 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 805 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 222 h3BNC117.52.64 AAS + SAV + YTE/ huSP34.39.13scFv AAS + W + YTE | SEQ ID NO: 806 EVQLVESGGGLVQPGGSLRLSCAASGFTFNT YAMNWVRQAPGKGLEWVGRIRSKYNNYATYY ADSVKGRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 801 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 223 h3BNC117.52.64 AAS + SAV + R/ huSP34.39.13scFv AAS + W + YTE | SEQ ID NO: 806 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 803 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNRYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 224 h3BNC117.52.64 AAS + SAV + R/ huSP34.39.13sc Fv AAS + W | SEQ ID NO: 807 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 803 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNRYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 225 h3BNC117 .52.64 AAS + SAV/ huSP34.3 9.13scFv AAS + W | SEQ ID NO: 807 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 805 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNRYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 226 h3BNC117.52.64 AAS + W + YTE/ huSP34.39.13scFv AAS + SAV + R | SEQ ID NO: 808 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 809 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCLVKGFYPSDIAV EWESNGQPENNYKTTPPVLDSDGSFFLYSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 227 h3BNC117.52.64 AAS + W/ huSP34.39.13scFv AAs + SAV + R | SEQ ID NO: 808 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 810 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCLVKGFYPSDIAV EWESNGQPENNYKTTPPVLDSDGSFFLYSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 228 h3BNC117.52.64 AAS + SAV + YTE/ huSP34.1.3scFv AAS + W + YTE | SEQ ID NO: 811 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 801 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCAVKGFYPSDIAV EWESNGQPENNYKTTPPVLDSDGSFFLYSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 229 h3BNC117.52.64 AAS + W + YTE/ huSP34.1.3scFv AAS + SAV + R | SEQ ID NO: 812 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 809 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCLVKGFYPSDIAV EWESNGQPENNYKTTPPVLDSDGSFFLYSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 230 h3BNC117.52.64 AAS + W/ huSP34.1.3scFv AAS + SAV + R | SEQ ID NO: 812 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 810 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCLVKGFYPSDIAV EWESNGQPENNYKTTPPVLDSDGSFFLYSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 231 h3BNC117.52.64 AAS + SAV/ huSP34.1.3scFv AAS + W | SEQ ID NO: 813 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 805 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 232 h3BNC117.52.64 AAS + W + LS/ huSP34.1.3 scFv AAS + SAV + R | SEQ ID NO: 812 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 814 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLWCLVKGFYPSDIAV EWESNGQPENNYKTTPPVLDSDGSFFLYSKLTVDK SRWQQGNVFSCSVLHEALHSHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 233 h3BNC117.52.64 AAS + SAV + YTE/ huSP34.3.8scFv AAS + W + YTE | SEQ ID NO: 815 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 801 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 234 h3BNC117.52.64 AAS + SAV/ huSP34.3.8scFv AAS + W | SEQ ID NO: 816 EVQLVESGGGLVQPGGSLRLSCAASGFTFNT YAMNWVRQAPGKGLEWVGRIRSKYNNYATYY ADSVKGRFTISRDDSKNSLYLQMNSLKTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 805 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 235 h3BNC117.52.64 AAS + SAV + YTE/ huSP34.34.3scFv AAS + W + YTE | SEQ ID NO: 817 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 801 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLYITREPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 236 h3BNC117.52.64 AAS + SAV/ huSP34.34.3scFv AAS + W | SEQ ID NO: 818 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 805 QVQLLQSGAAVTKPGASVRVSCEASGYNIRDYFIH WWRQAPGQGLQWVGWINPKTGQPNNPRQFQGRVSL TRHASFDFDTFSFYMDLKALRSDDTAVYFCARQRS DYWDFDVWGSGTQVTVSSASTKGPSVFPLAPSSKS TSGGTAALGCLVKDYFPEPVTVSWNSGALTSGVHT FPAVLQSSGLYSLSSVVTVPSSSLGTQTYICNVNH KPSNTKVDKKVEPKSCDKTHTCPPCPAPEAAGGPS VFLFPPKPKDTLMISRTPEVTCVVVDVSHEDPEVK FNWYVDGVEVHNAKTKPREEQYNSTYRVVSVLTVL HQDWLNGKEYKCKVSNKALPASIEKTISKAKGQPR EPQVYTLPPSREEMTKNQVSLSCAVKGFYPSDIAV EWESNGQPENNYKTTPPVLDSDGSFFLVSKLTVDK SRWQQGNVFSCSVMHEALHNHYTQKSLSLSPGK | SEQ ID NO: 802 DIQMTQSPSSLSASVG DTATITCQANGYLNWY QQRRGKAPKLLIYDGS KLERGVPSRFSGRRWG QEYNLTINNLQPEDIA TYFCQVYEFVVPGTRL DLKRTVAAPSVFIFPP SDEQLKSGTASVVCLL NNFYPREAKVQWKVDN ALQSGNSQESVTEQDS KDSTYSLSSTLTLSKA DYEKHKVYACEVTHQG LSSPVTKSFNRGEC |
| 239 hPGT121.66 AAS + SAV + YTE/ huSP34.3.13scFv AAS + W + YTE | SEQ ID NO: 821 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 822 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 240 hPGT121.66 AAS + SAV + R/ huSP34.3.13scFv AAS + W + YTE | SEQ ID NO: 824 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 825 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 241 hPGT121.66 AAS + SAV + R/ huSP34.3.13scFv AAS + W | SEQ ID NO: 826 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 825 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 242 hPGT121.66 AAS + SAV/ huSP34.3.13scFv AAS + W | SEQ ID NO: 826 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 827 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 243 hPGT121.66 AAS + W/ huSP34.3.13 scFv AAs + sAv + | SEQ ID NO: 828 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 829 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 244 hPGT121.66 AAS + SAV + YTE/huSP 34.39.13 scFv AAS + W + YTE | SEQ ID NO: 830 EVQLVESGGGLVQPGGSLRLSCAASGFTFNT YAMNWVRQAPGKGLEWVGRIRSKYNNYATYY ADSVKGRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 822 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPPSSEELQANK ATLVCLISDFYPGAVT VAWKADSSPVKAGVET TTPSKQSNNKYAASSY LSLTPEQWKSHRSYSC QVTHEGSTVEKTVAPT ECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 245 hPGT121.66 AAS + SAV + R/ huSP34.39.13scFv AAS + W + YTE | SEQ ID NO: 830 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 825 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 246 hPGT121.66 AAS + SAV + R/ huSP34.39.13scFv AAS + W | SEQ ID NO: 831 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 825 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 247 hPGT121.66 AAS + SAV/ huSP34.39.13scFv AAS + W | SEQ ID NO: 831 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 827 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 248 hPGT121.66 AAS + W + YTE/ huSP3439.13scFv AAs + SAV + R | SEQ ID NO: 832 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNHYTQKSLSLSPGK | SEQ ID NO: 833 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNRYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 249 hPGT121.66 AAS + W/ huSP34.39.13scFv AAs + SAV + R | SEQ ID NO: 832 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVGRIRPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 829 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 250 hPGT121.66 AAS + SAV/ huSP34.1.3scFv AAs + W | SEQ ID NO: 834 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNRYTQKSLSLSPGK | SEQ ID NO: 827 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 251 hPGT121.66 AAS + W/ huSP34.1.3scFv AAs + SAV + RF | SEQ ID NO: 835 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRFTQKSLSLSPGK | SEQ ID NO: 829 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 252 hPGT121.66 AAS + W/ huSP34.1.3scFv AAs + SAV + R | SEQ ID NO: 836 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 829 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 253 hPGT121.66 AAS + W + YTE/ huSP34.1.3scFv AAS + SAV + R | SEQ ID NO: 837 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 833 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 254 hPGT121.66 AAS + W + LS/ huSP34.1.3 scFv AAS + SAV + R | SEQ ID NO: 837 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 838 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVLHEALHSHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 255 hPGT121.66 W/ huSP34.1.3scFv SAV + R | SEQ ID NO: 839 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPELLGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPAPIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 840 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APELLGGPSVFLFPPKPKDTLMISRTPEVTCVVVD VSHEDPRVVSVLTVLHQDWLNGKEYKCKVSNKALPAPIE KTEVKFNWYVDGVEVHNAKTKPREEQYNSTY RVVSVLTVLHQDWLNGKEYKCKVSNKALPAPIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 256 hPGT121.66 AAS + W/ huSP34.3.8scFv AAS + SAV + R | SEQ ID NO: 841 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 829 QMQLQESGPGLVKPSETLSLTCSVSGASISDSYWS WIRRSPGKGLEWIGYVHKSGDTNYNPSLKSRVHLS LDTSKNQVSLSLTGVTAADSGKYYCARTLHGRRIY GIVAFNEWFTYFYMDVWGTGTQVTSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 257 hPGT121.66 AAS + W/ huSP34.34.3scFv AAS + SAV + R | SEQ ID NO: 842 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 829 QMQLQESGPGLVKPSETLSLTCSVSGASISDSYWS WIRRSPGKGLEWIGYVHKSGDTNYNPSLKRVHLS LDTSKNQVSLSLTGVTAADSGKYYCARTLHGRRIY GIVAFNEWFTYFYMDVWGTGTQVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 823 SDISVAPGETARISCG EKSLGSRAVQWYQHRA GQAPSLIIYNNQDRPS GIPERFSGSPDFRPGT TATLTITSVEAGDEAD YYCHIWDSRVPTKWVF GGGTTLTVLGQPKAAP SVTLFPPSSEELQANK ATLVCLISDFYPGAVT VAWKADSSPVKAGVET TTPSKQSNNKYAASSY LSLTPEQWKSHRSYSC QVTHEGSTVEKTVAPT ECS |
| 278 10-1074 AAS + SAV + YTE/ huSP34.3.13scFv AAS + W + YTE | SEQ ID NO: 861 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 862 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPRVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 279 10-1074 AAS + SAV + R/huSP34 3.13scFv AAS + W + YTE | SEQ ID NO: 861 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 864 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 280 10-1074 AAS + SAV + R/ huSP343.13scFv AAS + W | SEQ ID NO: 865 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 864 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 281 10-1074 AAS + SAV/ huSP34.3.13scFv AAS + W | SEQ ID NO: 865 EVQLVESGGGLVQPGGSLRLSCAASGFTNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 866 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 282 10-1074 AAS + W/ huSP34.3.13scFv AAS + SAV + R | SEQ ID NO: 867 EVQLVESGGGLVQPGGSLRLSCAASGFTNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNHYTQKSLSLSPGK | SEQ ID NO: 868 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 283 10-1074 AAS + SAV + YTE/ huSP34.39.13scFv AAS + W + YTE | SEQ ID NO: 869 EVQLVESGGGLVQPGGSLRLSCAASGFTNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 862 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 284 10-1074 AAS + SAV + R/ huSP34.39.13scFv AAS + W + YTE | SEQ ID NO: 869 EVQLVESGGGLVQPGGSLRLSCAASGFTNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 864 QVQLQESGPGLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LYSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |

TABLE G-continued amino acid sequences of illustrative CD3/gp120-targeting bi-specific binding molecules

| Ab name/<br>features | unpaired HC | Fab Arm - HC (VH-Fc) | Fab Arm - LC (VL-CL) |
|---|---|---|---|
| 285<br>10-1074<br>AAS + SAV +<br>R/<br>huSP34.39.13sc<br>Fv AAS + W | SEQ ID NO: 870<br>EVQLVESGGGLVQPGGSLRLSCAASGFTFNT<br>YAMNWVRQAPGKGLEWVGRIRSKYNNYATYY<br>ADSVKSRFTISRDDSKNSLYLEMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 864<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 286<br>10-1074<br>AAS + SAV/<br>huSP34.39.13scFv<br>AAS + W | SEQ ID NO: 870<br>EVQLVESGGGLVQPGGSLRLSCAASGFTFNT<br>YAMNWVRQAPGKGLEWVGRIRSKYNNYATYY<br>ADSVKSRFTISRDDSKNSLYLEMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 866<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 287<br>10-1074<br>AAS + W +<br>YTE/<br>huSP34.39.13scFv<br>AAS + SAV +<br>R | SEQ ID NO: 871<br>EVQLVESGGGLVQPGGSLRLSCAASGFTFNT<br>YAMNWVRQAPGKGLEWVGRIRSKYNNYATYY<br>ADSVKSRFTISRDDSKNSLYLEMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNHYTQKSLSLSPGK | SEQ ID NO: 872<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLYITREPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLWCLVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 288<br>10-1074<br>AAS + W/<br>huSP34.39.13scFv<br>AAS + SAV +<br>R | SEQ ID NO: 871<br>EVQLVESGGGLVQPGGSLRLSCAASGFTFNT<br>YAMNWVRQAPGKGLEWVGRIRSKYNNYATYY<br>ADSVKSRFTISRDDSKNSLYLEMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTSNRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNHYTQKSLSLSPGK | SEQ ID NO: 868<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLWCLVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 289<br>10-1074<br>AAS + SAV + YTE/<br>huSP34.1.3scFv<br>AAS + W + YTE | SEQ ID NO: 873<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLYITREPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 862<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 290<br>10-1074<br>AAS + SAV/<br>huSP34.1.3scFv<br>AAS + W | SEQ ID NO: 874<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 866<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 291<br>10-1074<br>AAS + W + YTE/<br>huSP34.1.3<br>scFv<br>AAS + SAV + R | SEQ ID NO: 875<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNRYTQKSLSLSPGK | SEQ ID NO: 872<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLYITREPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLWCLVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 292<br>10-1074<br>AAS + W/<br>huSP34.1.3<br>scFv<br>AAS + SAV + R | SEQ ID NO: 875<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLMISRTPEVICVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNRYTQKSLSLSPGK | SEQ ID NO: 868<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVICVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLWCLVK<br>GFYPSDIAVEWESNGQPENNYKTTPPVLDSDGSFF<br>LYSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 293<br>10-1074<br>AAS + W + LS/<br>huSP34.1.3 scFv<br>AAS + SAV +<br>R | SEQ ID NO: 875<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLMISRTPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LSCAVKGFYPSDIAVEWESNGQPENNYKTTP<br>PVLDSDGSFFLVSKLTVDKSRWQQGNVFSCS<br>VMHEALHNRYTQKSLSLSPGK | SEQ ID NO: 876<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLCLVK<br>GFYPSDIAVEWESNGQPENNYKTTPPVLDSDGSFF<br>LYSKLTVDKSRWQQGNVFSCSVLHEALHSHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 294<br>10-1074<br>AAS + SAV +<br>YTE/<br>huSP34.3.8scFv<br>AAS + W + YTE | SEQ ID NO: 877<br>EVQLVESGGGLVQPGGSLRLSCAASGFTFNT<br>YAMNWVRQAPGKGLEWVGRIRSKYNNYATYY<br>ADSVKGRFTISRDDSKNSLYLQMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLYITREPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 862<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLYITREPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LVSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 295<br>10-1074<br>AAS + SAV/<br>huSP34.3.8scFv<br>AAS + W | SEQ ID NO: 878<br>EVQLVESGGGLVQPGGSLRLSCAASGFTFNT<br>YAMNWVRQAPGKGLEWVGRIRSKYNNYATYY<br>ADSVKGRFTISRDDSKNSLYLQMNSLRTEDT<br>AVYYCVRHGNFGHSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPGVPARFSGSLLGGK<br>AALTISGAQPEDEAEYYCALWYSNRWVFGGG<br>TKLTVLEPKSSDKTHTCPPCPAPEAAGGPSV<br>FLFPPKPKDTLMISRTPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 866<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLMISRTPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LVSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |
| 296<br>10-1074<br>AAS + SAV<br>YTE/<br>huSP34.34.3scFv<br>AAS + W + YTE | SEQ ID NO: 879<br>EVQLVESGGGLVQPGGSLRLSCAASGFTFNT<br>YAMNWVRQAPGKGLEWVGRIRSKYNNYATYY<br>AASVKGRFTISRDDSKNSLYLQMNSLKTEDT<br>AMYYCVRHGNFGNSYVSWFAYWGQGTLVTVS<br>SGGGGSGGGGSGGGGSGGGGSQAVVTQEPSL<br>TVSPGGTVTLTCGSSTGAVTTGHYANWVQQK<br>PGQAPRGLIGGTNKRAPWTPARFSGSLLGGK<br>AALTLSGAQPEDEAEYYCALWYSNLWVFGGG<br>TKLTVLEPKSSDKTHTCPPCPAPEAAGGPSV<br>FLFPPKPKDTLYITREPEVTCVVVDVSHEDP<br>EVKFNWYVDGVEVHNAKTKPREEQYNSTYRV<br>VSVLTVLHQDWLNGKEYKCKVSNKALPASIE<br>KTISKAKGQPREPQVYTLPPSREEMTKNQVS<br>LWCLVKGFYPSDIAVEWESNGQPENNYKTTP<br>PVLDSDGSFFLYSKLTVDKSRWQQGNVFSCS<br>VMHEALHNHYTQKSLSLSPGK | SEQ ID NO: 862<br>QVQLQESGPGLVKPSETLSVTCSVSGDSMNNYYWT<br>WIRQSPGKGLEWIGYISDRESATYNPSLNSRVVIS<br>RDTSKNQLSLKLNSVTPADTAVYYCATARRGQRIY<br>GVVSFGEFFYYYSMDVWGKGTTVIVSSASTKGPSV<br>FPLAPSSKSTSGGTAALGCLVKDYFPEPVTVSWNS<br>GALTSGVHTFPAVLQSSGLYSLSSVVTVPSSSLGT<br>QTYICNVNHKPSNTKVDKKVEPKSCDKTHTCPPCP<br>APEAAGGPSVFLFPPKPKDTLYITREPEVTCVVVD<br>VSHEDPEVKFNWYVDGVEVHNAKTKPREEQYNSTY<br>RVVSVLTVLHQDWLNGKEYKCKVSNKALPASIEKT<br>ISKAKGQPREPQVYTLPPSREEMTKNQVSLSCAVK<br>GFYPSDIAVEWESNGQPENNYKTTPPVLDSDGSFF<br>LVSKLTVDKSRWQQGNVFSCSVMHEALHNHYTQKS<br>LSLSPGK | SEQ ID NO: 863<br>SYVRPLSVALGETARI<br>SCGRQALGSRAVQWYQ<br>HRPGQAPILLIYNNQD<br>RPSGIPERFSGTPDIN<br>FGTRATLTISGVEAGD<br>EADYYCHMWDSRSGFS<br>WSFGGATRLTVLGQPK<br>AAPSVTLFPPSSEELQ<br>ANKATLVCLISDFYPG<br>AVTVAWKADSSPVKAG<br>VETTTPSKQSNNKYAA<br>SSYLSLTPEQWKSHRS<br>YSCQVTHEGSTVEKTV<br>APTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 297 10-1074 AAS + SAV/ huSP34.34.3scFv AAS + W | SEQ ID NO: 880 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 866 QVQLQESGPGKLVKPSETLSVTCSVSGDSMNNYYWT WIRQSPGKGLEWIGYISDRESATYNPSLNSRVVIS RDTSKNQLSLKLNSVTPADTAVYYCATARRGQRIY GVVSFGEFFYYYSMDVWGKGTTVIVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 863 SYVRPLSVALGETARI SCGRQALGSRAVQWYQ HRPGQAPILLIYNNQD RPSGIPERFSGTPDIN FGTRATLTISGVEAGD EADYYCHMWDSRSGFS WSFGGATRLTVLGQPK AAPSVTLFPPSSEELQ ANKATLVCLISDFYPG AVTVAWKADSSPVKAG VETTTPSKQSNNKYAA SSYLSLTPEQWKSHRS YSCQVTHEGSTVEKTV APTECS |
| 298 PGT-134 AAS + SAV + YTE/ huSP34.3.13scFv AAS + W + YTE | SEQ ID NO: 881 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 882 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 299 PGT-134 AAS + SAV + R/ huSP34.3.13scFv AAS + W + YTE | SEQ ID NO: 881 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 884 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 300 PGT-134 AAS + SAV + R/ huSP34.3.13scFv AAS + W | SEQ ID NO: 885 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 884 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 301 PGT-134 AAS + SAV/ huSP34.3.13scFv AAS + W | SEQ ID NO: 885 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 886 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 302 PGT-134 AAS + W/hu SP34.3.13scFv AAS + SAV + R | SEQ ID NO: 887 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNHYTQKSLSLSPGK | SEQ ID NO: 888 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLCLVK GFYPSDIAVEWESNGQPENNYKTTPPVLDSDGSFF LYSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 303 PGT-134 AAS + SAV + YTE/ huSP34.39.13 scFv AAS + W + YTE | SEQ ID NO: 889 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 882 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 304 PGT-134 AAS + SAV + R/ huSP34.39.13scFv AAS + W + YTE | SEQ ID NO: 889 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 884 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 305 PGT-134 AAS + SAV + R/ huSP34.39.13scFv AAS + W | SEQ ID NO: 890 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG APEAAGGPSVFLFPPKPKDTLMISRTPEVTCVVVD TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 884 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LYSKLTVDKSRWQQGNVFSCSVMHEALHNRYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 306 PGT-134 AAS + SAV/ huSP34.39.13scFv AAS + W | SEQ ID NO: 890 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG APEAAGGPSVFLFPPKPKDTLMISRTPEVTCVVVD TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 886 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LYSKLTVDKSRWQQGNVFSCSVMHEALHNRYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 307 PGT-134 AAS + W + YTE/ huSP34.39.13scFv AAS + SAV + R | SEQ ID NO: 891 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG APEAAGGPSVFLFPPKPKDTLYITREPEVTCVVVD TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVK VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 892 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNRYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 308 PGT-134 AAS + W/ huSP34.39.13scFv AAS + SAV + R | SEQ ID NO: 891 EVQLVESGGGLVQPGGSLRLSCAASGFTFNT YAMNWVRQAPGKGLEWVGRIRSKYNNYATYY ADSVKSRFTISRDDSKNSLYLEMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTSNRAPGVPARFSGSLLGGK AALTISGAQPEDEAEYYCALWYSNRWVFGGG APEAAGGPSVFLFPPKPKDTLMISRTPEVTCVVVD TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 888 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNRYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 309 PGT-134 AAS + SAV + YTE/ huSP34.1.3scFv AAS + W + YTE | SEQ ID NO: 893 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 882 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 310 PGT-134 AAS + SAV/ huSP34.1.3scFv AAS + W | SEQ ID NO: 894 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 886 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 311 PGT-134 AAS + W + YTE/ huSP34.1.3 scFv AAS + SAV + R | SEQ ID NO: 895 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 892 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 312 PGT-134 AAS + W/ huSP34.1.3 scFv AAS + SAV + R | SEQ ID NO: 895 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 888 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPRVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

TABLE G-continued amino acid sequences of illustrative CD3/gp120-targeting bi-specific binding molecules

| Ab name/ features | unpaired HC | Fab Arm - HC (VH-Fc) | Fab Arm - LC (VL-CL) |
|---|---|---|---|
| 313 PGT-134 AAS + W + LS/ huSP34.1.3 scFv AAS + SAV + R | SEQ ID NO: 895 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LSCAVKGFYPSDIAVEWESNGQPENNYKTTP PVLDSDGSFFLVSKLTVDKSRWQQGNVFSCS VMHEALHNRYTQKSLSLSPGK | SEQ ID NO: 896 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLWCLVK GFYPSDIAVEWESNGQPENNYKTTPPVLDSDGSFF LYSKLTVDKSRWQQGNVFSCSVLHEALHSHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 314 PGT-134 AAS + SAV + YTE/ huSP34.3.8scFv AAS + W + YTE | SEQ ID NO: 897 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPGVPARFSGSLLGGK AALTISGAQPEDEAEYYCALWYSNRWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 882 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 315 PGT-134 AAS + SAV/ huSP34.3.8scFv AAS + W | SEQ ID NO: 898 EVQLVESGGGLVQPGGSLRLSCAASGFTFNT YAMNWVRQAPGKGLEWVGRIRSKYNNYATYY ADSVKGRFTISRDDSKNSLYLQMNSLRTEDT AVYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPGVPARFSGSLLGGK AALTISGAQPEDEAEYYCALWYSNRWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 886 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |
| 316 PGT-134 AAS + SAV + YTE/ huSP34.34.3scFv AAS + W + YTE | SEQ ID NO: 899 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGNSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLYITREPEVTCVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 882 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLYITREPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

TABLE G-continued amino acid sequences of illustrative CD3/gp120-targeting bi-specific binding molecules

| Ab name/features | unpaired HC | Fab Arm - HC (VH-Fc) | Fab Arm - LC (VL-CL) |
|---|---|---|---|
| 317 PGT-134 AAS + SAV/ huSP34.34.3scFv AAS + W | SEQ ID NO: 900 EVQLVESGGGLVQPGGSLRLSCAASGFTFNT YAMNWVRQAPGKGLEWVGRIRSKYNNYATYY AASVKGRFTISRDDSKNSLYLQMNSLKTEDT AMYYCVRHGNFGHSYVSWFAYWGQGTLVTVS SGGGGSGGGGSGGGGSGGGGSQAVVTQEPSL TVSPGGTVTLTCGSSTGAVTTGHYANWVQQK PGQAPRGLIGGTNKRAPWTPARFSGSLLGGK AALTLSGAQPEDEAEYYCALWYSNLWVFGGG TKLTVLEPKSSDKTHTCPPCPAPEAAGGPSV FLFPPKPKDTLMISRTPEVICVVVDVSHEDP EVKFNWYVDGVEVHNAKTKPREEQYNSTYRV VSVLTVLHQDWLNGKEYKCKVSNKALPASIE KTISKAKGQPREPQVYTLPPSREEMTKNQVS LWCLVKGFYPSDIAVEWESNGQPENNYKTTP PVLDSDGSFFLYSKLTVDKSRWQQGNVFSCS VMHEALHNHYTQKSLSLSPGK | SEQ ID NO: 886 QVHLQESGPGLVTPSETLSLTCTVSNGSVSGRFWS WIRQSPGRGLEWIGYFSDTDRSEYNPSLRSRLTLS VDRSKNQLSLKLKSVTAADSATYYCARAQQGKRIY GIVSFGELFYYYMDAWGKGTPVTVSSASTKGPSV FPLAPSSKSTSGGTAALGCLVKDYFPEPVTVSWNS GALTSGVHTFPAVLQSSGLYSLSSVVTVPSSSLGT QTYICNVNHKPSNTKVDKKVEPKSCDKTHTCPPCP APEAAGGPSVFLFPPKPKDTLMISRTPEVTCVVVD VSHEDPEVKFNWYVDGVEVHNAKTKPREEQYNSTY RVVSVLTVLHQDWLNGKEYKCKVSNKALPASIEKT ISKAKGQPREPQVYTLPPSREEMTKNQVSLSCAVK GFYPSDIAVEWESNGQPENNYKTTPPVLDSDGSFF LVSKLTVDKSRWQQGNVFSCSVMHEALHNHYTQKS LSLSPGK | SEQ ID NO: 883 SLNPLSLAPGATAKIP CGERSRGSRAVQWYQQ KPGQAPTLIIYNNQDR PAGVSERFSGNPDVAI GVTATLTISRVEVGDE GDYYCHYWDSRSPISW IFAGGTQLTVLGQPKA APSVTLFPPSSEELQA NKATLVCLISDFYPGA VTVAWKADSSPVKAGV ETTTPSKQSNNKYAAS SYLSLTPEQWKSHRSY SCQVTHEGSTVEKTVA PTECS |

In some embodiments, one or more of the polypeptides comprising the multispecific antigen binding molecules described herein comprise an N-terminal signal peptide. The signal peptide can be an endogenous signal peptide (e.g., from a native or wild-type immunoglobulin or CD4 ECD protein), or from a heterologous polypeptide. In various embodiments, the signal peptide or leader sequence is from a source protein selected from a serum protein, an immunoglobulin, a cytokine, a chemokine, a chaperone protein, an invariant protein, and a protein that directs proteins to the lysosomal compartment. In various embodiments, the signal peptide or leader sequence is from a source protein selected from colony stimulating factor 2 (CSF2, GM-CSF), tissue type plasminogen activator (PLAT, t-PA), C-C motif chemokine ligand 7 (CCL7, MCP-3), C—X—C motif chemokine ligand 10 (CXCL10, IP-10), catenin beta 1 (CTNNB1), CD74 (p33; DHLAG; HLADG; immunoglobulin Kappa; Ia-GAMMA, invariant chain), serum albumin (ALB), SPARC (osteonectin), cwcv and kazal like domains proteoglycan 1 (SPOCK1); SPARC (osteonectin), cwcv and kazal like domains proteoglycan 2 (SPOCK2); polyubiquitin B/C (UBB/UBC), calreticulin (CALR), vesicular stomatitis virus G protein (VSV-G), lysosomal associated membrane protein 1 (LAMP-1) and lysosomal associated membrane protein 2 (LAMP-2). In some embodiments, the signal peptide is from a serum albumin signal peptide (e.g., comprising the amino acid sequence KWVTFISLLFLFSSAYS (SEQ ID NO: 1026)). In various embodiments, the signal peptide or leader sequence is selected from an amino acid sequence of any one of SEQ ID NOs: 1026-1039, or a sequence that is at least 95%, 96%, 97%, 98%, or 99% identical to any one of SEQ ID NOs: 1026-1039. Illustrative signal sequences that can be used in the present multi-specific binding proteins are provided in Table H.

TABLE H illustrative signal sequences

| SEQ ID NO: | source protein name | SEQUENCE |
|---|---|---|
| 1026 | albumin | KWVTFISLLFLFSSAYS |
| 1027 | IL-2 | MYRMQLLSCIALSLALVTNS |
| 1028 | SPOCK1 | MPAIAVLAAAAAAWCFLQVES |
| 1029 | SPOCK2 | MRAPGCGRLVLPLLLLAAAALA |
| 1030 | Ig Kappa | METDTLLLWVLLLWVPG |
| 1031 | CSF2, GM-CSF | MWLQSLLLLGTVACSISV |
| 1032 | PLAT, t-PA | MDAMKRGLCCVLLLCGAVFVSAR |
| 1033 | CD74 | MHRRRSRSCREDQKPV |
| 1034 | β-catenin | MRKAAVSHWQQQSYLDSGIHSGATTTAPSLS |
| 1035 | CCL7, MCP-3 | MNPSAAVIFCLILLGLSGTQGILDMAQPVGINT STTCCYRFINKKIPKQRLESYRRTTSSHCPREA VIFKTKLDKEICADPTQKWVQDFMKHLDKKTQT PKLASAGA |
| 1036 | ubiquitin | MQIFVKTLIGKTITLEVEPSDTIENVKAKIQDK EGIPPDQQRLIFAGKQLEDGRTLSDYNIQKEST LHLVLRLRGG |
| 1037 | calreti-culin | MLLSVPLLLGLLGLAVA |
| 1038 | VSV-G | MKCLLYLAFLFIGVNC |
| 1039 | CXCL10, IP-10 | MNQTAILICCLIFLTLSGIQG |

The signal peptide can be designed to be cleaved off, e.g., after secretion from the cell, to form a mature fusion protein. A modified human serum albumin signal peptide to secrete proteins in cells that can find use in expressing the present fusion proteins is described, e.g., in Attallah, et al., *Protein Expr Purif.* (2017) 132:27-33. Additional signal peptide sequences for use in expressing the herein described fusion proteins are described, e.g., in Kober, et al., *Biotechnol Bioeng.* (2013) 110(4):1164-73.

In various embodiments, multi-specific antigen binding molecules described herein, and/or the polynucleotides encoding such polypeptides, are provided in provided in isolated form. This means that such the polypeptide or polynucleotide is at least 50% w/w pure of interfering proteins, cellular and other contaminants arising from its production or purification but does not exclude the possibility that the agent is combined with an excess of pharmaceutical acceptable carrier(s) or other vehicle intended to facilitate its use. The term "isolated," when applied to a polypeptide or polynucleotide, as described herein, denotes that the polypeptide or polynucleotide is essentially free of cellular components with which it is associated in the natural state. It can be, for example, in a homogeneous state and may be in either a dry or aqueous solution. Purity and homogeneity can be determined using known methods, e.g., analytical chemistry techniques such as polyacrylamide gel electrophoresis, column chromatography, thin layer chromatography, or high-performance liquid chromatography (HPLC) analysis. A protein that is the predominant species present in a preparation is substantially purified. An "isolated" or "purified" polypeptide or polynucleotide is substantially free of other cellular material, or culture medium when produced by recombinant techniques, or chemical precursors or other chemicals when chemically synthesized. In various embodiments, purified polypeptides and/or polynucleotides are at least 60%, 70%, 75%, 80%, 85%, 90%, 91%, 92%, 93%, 94%, 95%, 96%, 97%, 98%, 99%, or 100% (w/w), separated from, purified of, or free of interfering proteins and contaminants from production or purification. Often a multi-specific antigen binding molecule is the predominant macromolecular species remaining after its purification.

5. Conjugated Multi-Specific Antigen Binding Molecules

Any of the multi-specific antigen binding molecules described herein may be conjugated antigen binding molecules which are bound to various molecules (e.g., labels) including without limitation macromolecular substances such as polymers (e.g., polyethylene glycol (PEG), polyethylenimine (PEI) modified with PEG (PEI-PEG), polyglutamic acid (PGA) (N-(2-Hydroxypropyl) methacrylamide (HPMA) copolymers), hyaluronic acid, radioactive materials (e.g. $^{90}$Y, $^{131}$I, $^{125}$I, $^{35}$S, $^{3}$H, $^{121}$In, $^{99}$Tc), fluorescent substances (e.g., fluorescein and rhodamine), luminescent substances (e.g., luminol), haptens, enzymes (e.g., glucose oxidase), metal chelates, biotin, avidin, and drugs.

The above-described conjugated multi-specific antigen binding molecules can be prepared according to known methods, e.g., performing chemical modifications on the antigen binding molecules or the lower molecular weight forms thereof described herein. Methods for modifying antibodies are well known in the art (e.g., U.S. Pat. Nos. 5,057,313 and 5,156,840).

6. Polynucleotides Encoding Multi-Specific Antigen Binding Molecules

Provided are polynucleotides encoding the multi-specific antigen binding molecules, described herein, vectors comprising such polynucleotides, and host cells (e.g., mammalian cells, plant cells, yeast cells, bacteria cells including *E. coli* cells) comprising such polynucleotides or expression vectors. Provided herein are polynucleotides comprising nucleotide sequence(s) encoding any of the multi-specific antigen binding molecules provided herein, as well as expression cassettes and vector(s) comprising such polynucleotide sequences, e.g., expression vectors for their efficient expression in host cells, e.g., mammalian cells.

Further provided are polynucleotides or nucleic acid molecules encoding a multi-specific antigen binding molecule or antigen binding fragment thereof, as described herein. In some embodiments, the polynucleotides encode an immunoglobulin heavy chain variable region (or a fragment thereof) and an immunoglobulin light chain variable region (or a fragment thereof), of one or both of the anti-CD3 binding domain and an anti-HIV antigen (e.g., anti-gp120, anti-gp41). In other embodiments, the polynucleotides or nucleic acid molecules are DNA, cDNA, or mRNA. In some other embodiments, the polynucleotides or nucleic acid molecules are codon-biased to enhance expression in a desired host cell.

In some embodiments, provided are polynucleotides encoding the VH, VL, or VH and VL of one or both of the first and second binding domains of the multi-specific antigen binding molecules or antigen binding fragments which bind to gp120. In certain instances, the polynucleotides encode one or more of CDRs, VH, VL, HC, LC and Fc regions comprising the amino acid sequences of the multi-specific antigen binding molecules set forth in one or more of Tables A1-A4, B1-B2, C, D1-D4, E, F and G, as described herein.

Provided herein are polynucleotides encoding the CDRs, VH, VL, light chain, or heavy chain of a multi-specific antigen binding molecule, described herein. In one embodiment, the polynucleotides can comprise nucleotide sequences encoding a heavy chain or heavy chain variable domain targeting CD3 comprising the VH CDRs of antibodies described herein (see, e.g., Tables A1-A4, B1, C and G, herein). In one embodiment, the polynucleotides can comprise nucleotide sequences encoding a light chain or light chain variable domain targeting CD3 comprising the VL CDRs of multi-specific antigen binding molecules described herein (see, e.g., Tables A1-A4, B2, C and G, herein). In one embodiment, a polynucleotide described herein encodes a heavy chain variable region or a heavy chain comprising VH-CDRs targeting CD3 comprising the amino acid sequences set forth in Tables A1, A2, A3 or A4, respectively. In one embodiment, a polynucleotide described herein encodes a light chain variable region or a light chain comprising VL-CDRs targeting CD3 comprising the amino acid sequences set forth in Tables A1, A2, A3 or A4, respectively. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Kabat), respectively: SEQ ID NOs: 1, 11, 8, 4, 9 and 10; SEQ ID NOs: 1, 12, 8, 4, 9 and 10; SEQ ID NOs: 1, 13, 8, 4, 14 and 15; SEQ ID NOs: 1, 13, 16, 4, 14 and 15; or SEQ ID NOs: 1, 11, 8, 4, 14 and 10. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Kabat), respectively: SEQ ID NOs: 1, 11, 8, 4, 9 and 10; or SEQ ID NOs: 1, 12, 8, 4, 9 and 10. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Kabat), respectively: SEQ ID NOs: 1, 11, 8, 4, 9 and 10. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Kabat), respectively: SEQ ID NOs: 1, 12, 8, 4, 9 and 10.

In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Chothia), respectively: SEQ ID NOs: 17, 18, 23, 20, 24 and 25; SEQ ID NOs: 17, 18, 23, 20, 26 and 27; SEQ ID NOs: 17, 18, 75, 20, 26 and 27; or SEQ ID NOs: 17, 18, 23, 20, 26 and 25. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Chothia), respectively: SEQ ID NOs: 17, 18, 23, 20, 24 and 25.

In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to IMGT), respectively: SEQ ID NOs: 28, 29, 32, 31, 24 and 10; SEQ ID NOs: 28, 29, 32, 31, 26 and 15; SEQ ID NOs: 28, 29, 33, 31, 26 and 15; or SEQ ID NOs: 28, 29, 32, 31, 26 and 10. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to IMGT), respectively: SEQ ID NOs: 28, 29, 32, 31, 24 and 10.

In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Honegger), respectively: SEQ ID NOs: 34, 42, 40, 37, 41 and 25; SEQ ID NOs: 34, 43, 40, 37, 41 and 25; SEQ ID NOs: 34, 44, 40, 37, 45 and 27; SEQ ID NOs: 34, 44, 46, 37, 45 and 27; or SEQ ID NOs: 34, 42, 40, 37, 47 and 25. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Honegger), respectively: SEQ ID NOs: 34, 42, 40, 37, 41 and 25; or SEQ ID NOs: 34, 43, 40, 37, 41 and 25. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Honegger), respectively: SEQ ID NOs: 34, 42, 40, 37, 41 and 25. In some embodiments, the polynucleotide or polynucleotides encode a first heavy chain variable domain (VH) and a first light chain variable domain (VL) that target, bind to or specifically bind to CD3, comprising a first VH-CDR1, a first VH-CDR2, a first VH-CDR3, a first VL-CDR1, a first VL-CDR2 and a first VL-CDR3 comprising the following amino acid sequences (according to Honegger), respectively: SEQ ID NOs: 34, 43, 40, 37, 41 and 25.

In one embodiment, a polynucleotide described herein encodes a heavy chain variable region or a heavy chain targeting CD3 comprising the amino acid sequences set forth in Table B1. In one embodiment, a polynucleotide described herein encodes a light chain variable region or a light chain targeting CD3 comprising the amino acid sequences set forth in Table B2. In some embodiments, the polynucleotide encodes a first VH comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence selected from the group consisting of SEQ ID NOs: 48-53. In some embodiments, the polynucleotide encodes a first VH comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence of SEQ ID NO: 50. In some embodiments, the polynucleotide encodes a first VH comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence of SEQ ID NO: 51. In some embodiments, the polynucleotide encodes a first VL comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence of SEQ ID NO: 54-58. In some embodiments, the polynucleotide encodes a first VL comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence of SEQ ID NO: 56. In some embodiments, the polynucleotide or polynucleotides encode a first VH comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence selected from the group consisting of SEQ ID NOs: 48-53 and encode a first VL comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to an amino acid sequence of SEQ ID NO: 54-58. In some embodiments, the polynucleotide or polynucleotides encode a first VH comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence of SEQ ID NO: 51 and encode a first VL comprising an amino acid sequence that is at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence of SEQ ID NO: 56.

In various embodiments, the polynucleotide or polynucleotides encode a first VH and a first VL, the first VH and the first VL comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequences set forth, respectively: SEQ ID NOs: 48 and 54; SEQ ID NOs: 49 and 55; SEQ ID NOs: 50 and 55; SEQ ID NOs: 50 and 56; SEQ ID NOs: 51 and 55; SEQ ID NOs: 51 and 56; SEQ ID NOs: 52 and 56; SEQ ID NOs: 53 and 57; or SEQ ID NOs: 50 and 58. In various embodiments, the polynucleotide or polynucleotides encode a first VH and a first VL, the first VH and the first VL comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56.

In some embodiments, the polynucleotide or polynucleotides encode a first VH and a first VL, the first VH and the first VL comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence set forth, respectively: SEQ ID NO: 50 and 56. In some embodiments, the polynucleotide or polynucleotides encode a first VH and a first VL, the first VH and the first VL comprising amino acid sequences that are at least 95% identical to the amino acid sequence set forth, respectively: SEQ ID NO: 50 and 56. In some embodiments, the polynucleotide or polynucleotides encode a first VH and a first VL, the first VH and the first VL comprising amino acid sequences that are at least 99% identical to the amino acid sequence set forth, respectively: SEQ ID NO: 50 and 56. In some embodiments, the polynucleotide or polynucleotides encode a first VH and a first VL, the first VH and the first VL comprising amino acid sequences that are 100% identical to the amino acid sequence set forth, respectively: SEQ ID NO: 50 and 56. In some embodiments, the polynucleotide or polynucleotides encode a first VH and a first VL, the first VH comprising the amino acid sequence of SEQ ID NO: 50 and the first VL comprising an amino acid sequence that is at least 95% identical to the amino acid sequence of SEQ ID NO: 56. In some embodiments, the polynucleotide or polynucleotides encode a first VH and a first VL, the first VH comprising the amino acid sequence of SEQ ID NO: 50 and the first VL comprising an amino acid sequence that is at least 96% identical to the amino acid sequence of SEQ ID NO: 56. In some embodiments, the polynucleotide or polynucleotides encode a first VH and a first VL, the first VH comprising the amino acid sequence of SEQ ID NO: 50 and the first VL comprising an amino acid sequence that is at least 97% identical to the amino acid sequence of SEQ ID NO: 56. In some embodiments, the polynucleotide or polynucleotides encode a first VH and a first VL, the first VH comprising the amino acid sequence of SEQ ID NO: 50 and the first VL comprising an amino acid sequence that is at least 98% identical to the amino acid sequence of SEQ ID NO: 56. In some embodiments, the polynucleotide or polynucleotides encode a first VH and a first VL, the first VH comprising the amino acid sequence of SEQ ID NO: 50 and the first VL comprising an amino acid sequence that is at least 99% identical to the amino acid sequence of SEQ ID NO: 56. In some embodiments, the polynucleotide or polynucleotides encode a first VH and a first VL, the first VH comprising an amino acid sequence that is at least 95% identical to the amino acid sequence of SEQ ID NO: 50 and the first VL comprising the amino acid sequence of SEQ ID NO: 56. In some embodiments, the polynucleotide or polynucleotides encode a first VH and a first VL, the first VH comprising an amino acid sequence that is at least 96% identical to the amino acid sequence of SEQ ID NO: 50 and the first VL comprising the amino acid sequence of SEQ ID NO: 56. In some embodiments, the polynucleotide or polynucleotides encode a first VH and a first VL, the first VH comprising an amino acid sequence that is at least 97% identical to the amino acid sequence of SEQ ID NO: 50 and the first VL comprising the amino acid sequence of SEQ ID NO: 56. In some embodiments, the polynucleotide or polynucleotides encode a first VH and a first VL, the first VH comprising an amino acid sequence that is at least 98% identical to the amino acid sequence of SEQ ID NO: 50 and the first VL comprising the amino acid sequence of SEQ ID NO: 56. In some embodiments, the polynucleotide or polynucleotides encode a first VH and a first VL, the first VH comprising an amino acid sequence that is at least 99% identical to the amino acid sequence of SEQ ID NO: 50 and the first VL comprising the amino acid sequence of SEQ ID NO: 56.

In some embodiments, the polynucleotide or polynucleotides encode a first VH and a first VL, the first VH and the first VL comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequence set forth, respectively: SEQ ID NO: 51 and 56. In some embodiments, the polynucleotide or polynucleotides encode a first VH and a first VL, the first VH and the first VL comprising amino acid sequences that are at least 95% identical to the amino acid sequence set forth, respectively: SEQ ID NO: 51 and 56. In some embodiments, the polynucleotide or polynucleotides encode a first VH and a first VL, the first VH and the first VL comprising amino acid sequences that are at least 99% identical to the amino acid sequence set forth, respectively: SEQ ID NO: 51 and 56. In some embodiments, the polynucleotide or polynucleotides encode a first VH and a first VL, the first VH and the first VL comprising amino acid sequences that are 100% identical to the amino acid sequence set forth, respectively: SEQ ID NO: 51 and 56. In some embodiments, the polynucleotide or polynucleotides encode a first VH and a first VL, the first VH comprising the amino acid sequence of SEQ ID NO: 51 and the first VL comprising an amino acid sequence that is at least 95% identical to the amino acid sequence of SEQ ID NO: 56. In some embodiments, the polynucleotide or polynucleotides encode a first VH and a first VL, the first VH comprising the amino acid sequence of SEQ ID NO: 51 and the first VL comprising an amino acid sequence that is at least 96% identical to the amino acid sequence of SEQ ID NO: 56. In some embodiments, the polynucleotide or polynucleotides encode a first VH and a first VL, the first VH comprising the amino acid sequence of SEQ ID NO: 51 and the first VL comprising an amino acid sequence that is at least 97% identical to the amino acid sequence of SEQ ID NO: 56. In some embodiments, the polynucleotide or polynucleotides encode a first VH and a first VL, the first VH comprising the amino acid sequence of SEQ ID NO: 51 and the first VL comprising an amino acid sequence that is at least 98% identical to the amino acid sequence of SEQ ID NO: 56. In some embodiments, the polynucleotide or polynucleotides encode a first VH and a first VL, the first VH comprising the amino acid sequence of SEQ ID NO: 51 and the first VL comprising an amino acid sequence that is at least 99% identical to the amino acid sequence of SEQ ID NO: 56. In some embodiments, the polynucleotide or polynucleotides encode a first VH and a first VL, the first VH comprising an amino acid sequence that is at least 95% identical to the amino acid sequence of SEQ ID NO: 51 and the first VL comprising the amino acid sequence of SEQ ID NO: 56. In some embodiments, the polynucleotide or polynucleotides encode a first VH and a first VL, the first VH comprising an amino acid sequence that is at least 96% identical to the amino acid sequence of SEQ ID NO: 51 and the first VL comprising the amino acid sequence of SEQ ID NO: 56. In some embodiments, the polynucleotide or polynucleotides encode a first VH and a first VL, the first VH comprising an amino acid sequence that is at least 97% identical to the amino acid sequence of SEQ ID NO: 51 and the first VL comprising the amino acid sequence of SEQ ID NO: 56. In some embodiments, the polynucleotide or polynucleotides encode a first VH and a first VL, the first VH comprising an amino acid sequence that is at least 98% identical to the amino acid sequence of SEQ ID NO: 51 and the first VL comprising the amino acid sequence of SEQ ID NO: 56. In some embodiments, the polynucleotide or polynucleotides encode a first VH and a first VL, the first VH comprising an amino acid sequence that is at least 99% identical to the amino acid sequence of SEQ ID NO: 51 and the first VL comprising the amino acid sequence of SEQ ID NO: 56.

In some embodiments, the polynucleotide encodes a scFv comprising a VH and a VL, the scFv comprises an amino acid sequence that is at least 80%, at least 85%, at least 90%, at least 91%, at least 92%, at least 93%, at least 94%, at least 95%, at least 96%, at least 97%, at least 98%, at least 99%, or at least 100%, identical to an amino acid sequence selected from SEQ ID NOs: 59-66, e.g., SEQ ID NOs: 59-66, e.g., SEQ ID NOs: 59-63, e.g., SEQ ID NOs: 61, 62 or 63, e.g., SEQ ID NOs: 62 or 63.

Provided herein are polynucleotides encoding the CDRs, VH, VL, light chain, or heavy chain of a multi-specific antigen binding molecule, described herein. In one embodiment, the polynucleotides can comprise nucleotide sequences encoding a heavy chain or heavy chain variable domain targeting an HIV antigen (e.g., HIV gp120) comprising the VH CDRs of antibodies described herein (see, e.g., Tables D1-D4, E and G, herein). In one embodiment, the polynucleotides can comprise nucleotide sequences encoding a light chain or light chain variable domain targeting an HIV antigen (e.g., HIV gp120) comprising the VL CDRs of multi-specific antigen binding molecules described herein (see, e.g., Tables D1-D4, E and G, herein). In one embodiment, a polynucleotide described herein encodes a heavy chain variable region or a heavy chain comprising VH-CDRs targeting an HIV antigen (e.g., HIV gp120) comprising the amino acid sequences set forth in Tables D1, D2, D3 or D4, respectively. In one embodiment, a polynucleotide described herein encodes a light chain variable region or a light chain comprising VL-CDRs targeting an HIV antigen (e.g., HIV gp120) comprising the amino acid sequences set forth in Tables D1, D2, D3 or D4, respectively.

In one embodiments, the polynucleotide or polynucleotides encode a second heavy chain variable domain (VH) and a second light chain variable domain (VL) that target, bind to or specifically bind to an HIV antigen (e.g., HIV gp120), comprising a second VH-CDR1, a second VH-CDR2, a second VH-CDR3, a second VL-CDR1, a second VL-CDR2 and a second VL-CDR3 comprising the amino acid sequences (according to Kabat) set forth, respectively, in: SEQ ID NOs: 76, 77, 78, 79, 80 and 81; SEQ ID NOs: 76, 82, 78, 79, 80 and 81; SEQ ID NOs: 83, 84, 85, 86, 80 and 87; SEQ ID NOs: 83, 88, 85, 86, 80 and 87; SEQ ID NOs: 90, 91, 92, 93, 94 and 95; SEQ ID NOs: 90, 91, 96, 93, 94 and 95; SEQ ID NOs: 97, 98, 99, 100, 101 and 102; SEQ ID NOs: 103, 104, 105, 106, 94 and 107; SEQ ID NOs: 108, 109, 110, 111, 112 and 113; SEQ ID NOs: 114, 115, 116, 117, 118 and 119; SEQ ID NOs: 114, 120, 121, 122, 118 and 123; SEQ ID NOs: 124, 125, 126, 127, 128 and 113; SEQ ID NOs: 129, 115, 131, 127, 118 and 113; SEQ ID NOs: 132, 133, 134, 135, 136 and 137; SEQ ID NOs: 138, 139, 140, 141, 142 and 143; SEQ ID NOs: 144, 145, 146, 147, 148 and 143; SEQ ID NOs: 149, 150, 151, 152, 153 and 143; SEQ ID NOs: 154, 155, 156, 157, 158 and 159; SEQ ID NOs: 160, 161, 162, 163, 164 and 165; SEQ ID NOs: 166, 161, 167, 163, 164 and 165; SEQ ID NOs: 168, 169, 170, 171, 172 and 173; SEQ ID NOs: 168, 174, 170, 171, 172 and 173; SEQ ID NOs: 175, 176, 177, 171, 172 and 173; SEQ ID NOs: 178, 179, 180, 181, 182 and 183; SEQ ID NOs: 184, 185, 186, 187, 188 and 189; SEQ ID NOs: 190, 191, 192, 193, 194 and 195; SEQ ID NOs: 196, 197, 198, 199, 200 and 201; SEQ ID NOs: 202, 203, 204, 205, 206 and 207; SEQ ID NOs: 208, 209, 210, 211, 212 and 213; SEQ ID NOs: 214, 215, 216, 217, 218 and 219; SEQ ID NOs: 214, 220, 216, 221, 218 and 219; SEQ ID NOs: 214, 220, 222, 221, 218 and 219; SEQ ID NOs: 223, 224, 225, 226, 227 and 228; SEQ ID NOs: 229, 230, 231, 232, 233 and 234; SEQ ID NOs: 902, 903, 904, 905, 906 and 907; SEQ ID NOs: 908, 909, 910, 911, 912 and 913; SEQ ID NOs: 914, 915, 916, 917, 918 and 919; or SEQ ID NOs: 920, 921, 922, 923, 924 and 925.

In one embodiments, the polynucleotide or polynucleotides encode a second heavy chain variable domain (VH) and a second light chain variable domain (VL) that target, bind to or specifically bind to an HIV antigen (e.g., HIV gp120), comprising a second VH-CDR1, a second VH-CDR2, a second VH-CDR3, a second VL-CDR1, a second VL-CDR2 and a second VL-CDR3 comprising the amino acid sequences (according to Chothia) set forth, respectively, in: SEQ ID NOs: 235, 236, 237, 238, 239 and 240; SEQ ID NOs: 241, 242, 243, 244, 239 and 245; SEQ ID NOs: 246, 242, 247, 244, 239 and 245; SEQ ID NOs: 248, 249, 250, 251, 239 and 252; SEQ ID NOs: 248, 249, 253, 251, 239 and 252; SEQ ID NOs: 254, 255, 256, 257, 258 and 259; SEQ ID NOs: 260, 261, 262, 263, 239 and 264; SEQ ID NOs: 265, 266, 267, 268, 269 and 270; SEQ ID NOs: 271, 272, 273, 274, 275 and 270; SEQ ID NOs: 271, 276, 277, 278, 275 and 279; SEQ ID NOs: 280, 281, 282, 283, 284 and 270; SEQ ID NOs: 285, 272, 286, 283, 275 and 270; SEQ ID NOs: 287, 288, 289, 290, 291 and 292; SEQ ID NOs: 293, 294, 295, 296, 297 and 298; SEQ ID NOs: 299, 300, 301, 302, 303 and 298; SEQ ID NOs: 304, 300, 305, 406, 307 and 298; SEQ ID NOs: 308, 309, 310, 311, 312 and 313; SEQ ID NOs: 314, 315, 316, 317, 318 and 165; SEQ ID NOs: 320, 315, 321, 317, 318 and 165; SEQ ID NOs: 322, 323, 324, 325, 326 and 327; SEQ ID NOs: 322, 328, 324, 325, 326 and 327; SEQ ID NOs: 329, 323, 330, 325, 326 and 327; SEQ ID NOs: 331, 332, 333, 334, 335 and 336; SEQ ID NOs: 337, 338, 339, 340, 341 and 342; SEQ ID NOs: 343, 344, 345, 346, 341 and 347; SEQ ID NOs:348, 349, 350, 351, 352 and 353; SEQ ID NOs: 354, 355, 356, 357, 358 and 359; SEQ ID NOs: 360, 361, 362, 363, 364 and 365; SEQ ID NOs: 366, 367, 368, 369, 370 and 371; SEQ ID NOs: 366, 361, 368, 369, 370 and 371; SEQ ID NOs: 372, 361, 373, 369, 370 and 371; SEQ ID NOs: 374, 375, 376, 377, 378 and 379; or SEQ ID NOs: 380, 381, 382, 383, 384 and 385.

In one embodiments, the polynucleotide or polynucleotides encode a second heavy chain variable domain (VH) and a second light chain variable domain (VL) that target, bind to or specifically bind to an HIV antigen (e.g., HIV gp120), comprising a second VH-CDR1, a second VH-CDR2, a second VH-CDR3, a second VL-CDR1, a second VL-CDR2 and a second VL-CDR3 comprising the amino acid sequences (according to IMGT) set forth, respectively, in: SEQ ID NOs: 386, 387, 388, 389, 239 and 81; SEQ ID NOs: 390, 391, 392, 393, 239 and 87; SEQ ID NOs: 390, 391, 394, 393, 239 and 87; SEQ ID NOs: 395, 396, 397, 393, 239 and 87; SEQ ID NOs: 398, 399, 400, 401, 239 and 95; SEQ ID NOs: 398, 399, 402, 401, 239 and 95; SEQ ID NOs: 403, 404, 405, 406, 258 and 102; SEQ ID NOs: 407, 408, 409, 410, 239 and 107; SEQ ID NOs: 411, 412, 413, 414, 269 and 113; SEQ ID NOs: 415, 416, 417, 418, 275 and 119; SEQ ID NOs: 415, 419, 420, 421, 275 and 123; SEQ ID NOs: 422, 423, 424, 425, 275 and 113; SEQ ID NOs: 426, 416, 427, 425, 275 and 113; SEQ ID NOs: 428, 429, 430, 431, 291 and 137; SEQ ID NOs: 432, 433, 434, 435, 297 and 143; SEQ ID NOs: 436, 437, 438, 439, 303 and 143; SEQ ID NOs: 440, 437, 441, 442, 307 and 143; SEQ ID NOs: 443, 444, 445, 446, 312 and 159; SEQ ID NOs: 447, 448, 449, 450, 318 and 165; SEQ ID NOs: 451, 448, 452, 450, 318 and 165; SEQ ID NOs: 453, 454, 455, 456, 326 and 173; SEQ ID NOs: 453, 457, 455, 456, 326 and 173; SEQ ID NOs: 458, 459, 460, 456, 326 and 173; SEQ ID NOs: 461, 462, 463, 464, 335 and 183; SEQ ID NOs: 465, 466, 467, 468, 341 and 189; SEQ ID NOs: 469, 470, 471, 472, 341 and 195; SEQ ID NOs: 473, 474, 475, 476, 352 and 201; SEQ ID NOs: 477, 478, 479, 480, 358 and 207; SEQ ID NOs: 481, 482, 483, 484, 364 and 213; SEQ ID NOs: 485, 486, 487, 488, 370 and 219; SEQ ID NOs: 485, 482, 487, 488, 370 and 219; SEQ ID NOs: 489, 482, 490, 488, 370 and 219; SEQ ID NOs: 491, 492, 493, 494, 378 and 228; SEQ ID NOs: 495, 496, 497, 498, 384 and 234; SEQ ID NOs: 950, 951, 952, 953, 930 and 907; SEQ ID NOs: 954, 955, 956, 957, 936 and 913; SEQ ID NOs: 958, 959, 960, 961, 942 and 919; or SEQ ID NOs: 962, 963, 964, 965, 948 and 925.

In one embodiments, the polynucleotide or polynucleotides encode a second heavy chain variable domain (VH) and a second light chain variable domain (VL) that target, bind to or specifically bind to an HIV antigen (e.g., HIV gp120), comprising a second VH-CDR1, a second VH-CDR2, a second VH-CDR3, a second VL-CDR1, a second VL-CDR2 and a second VL-CDR3 comprising the amino acid sequences (according to Honegger) set forth, respectively, in: SEQ ID NOs: 499, 500, 501, 238, 502 and 240; SEQ ID NOs: 499, 503, 501, 238, 502 and 240; SEQ ID NOs: 505, 506, 507, 244, 502 and 245; SEQ ID NOs: 508, 509, 510, 244, 502 and 245; SEQ ID NOs: 511, 512, 513, 251, 514 and 252; SEQ ID NOs: 511, 512, 515, 251, 514 and 252; SEQ ID NOs: 516, 517, 518, 257, 519 and 259; SEQ ID NOs: 520, 521, 522, 264, 523 and 264; SEQ ID NOs: 524, 525, 526, 268, 527 and 270; SEQ ID NOs: 528, 529, 530, 274, 531 and 270; SEQ ID NOs: 528, 532, 533, 278, 531 and 279; SEQ ID NOs: 534, 535, 536, 283, 537 and 270; SEQ ID NOs: 1090, 529, 538, 283, 531 and 270; SEQ ID NOs: 539, 540, 541, 290, 542 and 292; SEQ ID NOs: 543, 544, 545, 546, 547 and 298; SEQ ID NOs: 548, 549, 550, 1091, 551 and 298; SEQ ID NOs: 552, 553, 554, 555, 556 and 298; SEQ ID NOs: 557, 558, 559, 311, 560 and 313; SEQ ID NOs: 561, 562, 563, 564, 565 and 165; SEQ ID NOs: 566, 562, 1092, 564, 567 and 165; SEQ ID NOs: 568, 569, 570, 571, 572 and 327; SEQ ID NOs: 568, 573, 570, 571, 572 and 327; SEQ ID NOs: 574, 575, 576, 571, 572 and 327; SEQ ID NOs: 577, 578, 579, 580, 581 and 336; SEQ ID NOs: 582, 583, 584, 340, 585 and 342; SEQ ID NOs: 586, 587, 588, 346, 589 and 347; SEQ ID NOs: 590, 591, 592, 351, 593 and 353; SEQ ID NOs: 594, 595, 596, 597, 598 and 359; SEQ ID NOs: 599, 600, 601, 602, 603 and 365; SEQ ID NOs: 604, 605, 606, 607, 608 and 371; SEQ ID NOs: 604, 609, 606, 607, 608 and 371; SEQ ID NOs: 610, 609, 611, 607, 608 and 371; SEQ ID NOs: 612, 613, 614, 615, 616 and 379; SEQ ID NOs: 617, 618, 619, 620, 621 and 385; SEQ ID NOs: 966, 967, 968, 969, 970 and 931; SEQ ID NOs: 971, 972, 973, 974, 975 and 937; SEQ ID NOs: 976, 977, 978, 941, 979 and 943; or SEQ ID NOs: 980, 981, 982, 983, 984 and 949.

In one embodiment, a polynucleotide described herein encodes a heavy chain variable region and a heavy chain targeting an HIV antigen (e.g., HIV gp120) comprising the amino acid sequences set forth in Table E. In various embodiments, the polynucleotide or polynucleotides encode a second VH and a second VL, the second VH and the second VL comprising amino acid sequences that are at least 80%, at least 85%, at least 90%, at least 91%, at least 92%, at least 93%, at least 94%, at least 95%, at least 96%, at least 97%, at least 98%, at least 99% identical, or are 100% identical, to the amino acid sequences set forth, respectively: SEQ ID NOs: 622 and 623; SEQ ID NOs: 624 and 625; SEQ ID NOs: 624 and 626; SEQ ID NOs: 627 and 628; SEQ ID NOs: 629 and 630; SEQ ID NOs: 631 and 632; SEQ ID NOs: 633 and 634; SEQ ID NOs: 635 and 636; SEQ ID NOs: 637 and 638; SEQ ID NOs: 639 and 640; SEQ ID NOs: 641 and 642; SEQ ID NOs: 643 and 644; SEQ ID NOs: 645 and 646; SEQ ID NOs: 647 and 648; SEQ ID NOs: 649 and 650; SEQ ID NOs: 651 and 652; SEQ ID NOs: 653 and 654; SEQ ID NOs: 655 and 656; SEQ ID NOs: 657 and 658; SEQ ID NOs: 659 and 660; SEQ ID NOs: 661 and 662; SEQ ID NOs: 663 and 664; SEQ ID NOs: 665 and 666; SEQ ID NOs: 667 and 668; SEQ ID NOs: 669 and 670; SEQ ID NOs:671 and 672; SEQ ID NOs:673 and 670; SEQ ID NOs: 674 and 675; SEQ ID NOs: 676 and 677; SEQ ID NOs: 678 and 679; SEQ ID NOs: 680 and 681; SEQ ID NOs: 682 and 683; SEQ ID NOs: 684 and 685; SEQ ID NOs: 686 and 687; SEQ ID NOs: 688 and 689; SEQ ID NOs: 690 and 691; SEQ ID NOs: 692 and 693; SEQ ID NOs: 694 and 695; SEQ ID NOs: 985 and 986; SEQ ID NOs: 987 and 988; SEQ ID NOs: 989 and 990; or SEQ ID NOs: 991 and 992.

In some embodiments, the polynucleotide or polynucleotides encode a first Fc region and a second Fc region, as set forth in Table F. In some embodiments, the polynucleotide or polynucleotides encode a first Fc region and a second Fc region, comprising amino acid sequences that are at least 80%, at least 85%, at least 90%, at least 91%, at least 92%, at least 93%, at least 94%, at least 95%, at least 96%, at least 97%, at least 98%, at least 99% identical, or are 100% identical, to the amino acid sequences set forth, respectively: SEQ ID NOs.: 696 and 697; SEQ ID NOs.: 697 and 696; SEQ ID NOs.: 696 and 698; SEQ ID NOs.: 698 and 696; SEQ ID NOs.: 699 and 700; SEQ ID NOs.: 700 and 699;

SEQ ID NOs.: 701 and 698; SEQ ID NOs.: 698 and 701; SEQ ID NOs.: 702 and 703; SEQ ID NOs.: 703 and 702; SEQ ID NOs.: 704 and 698; SEQ ID NOs.: 698 and 704; SEQ ID NOs.: 705 and 703; SEQ ID NOs.: 703 and 705; SEQ ID NOs.: 706 and 704; SEQ ID NOs.: 704 and 706; SEQ ID NOs.: 707 and 703; SEQ ID NOs.: 703 and 707; SEQ ID NOs.: 708 and 704; SEQ ID NOs.: 704 and 708; SEQ ID NOs.: 709 and 710; or SEQ ID NOs.: 710 and 709. In some embodiments, the polynucleotide or polynucleotides encode a first Fc region and a second Fc region, comprising amino acid sequences that are at least 80%, at least 85%, at least 90%, at least 91%, at least 92%, at least 93%, at least 94%, at least 95%, at least 96%, at least 97%, at least 98%, at least 99% identical, or are 100% identical, to the amino acid sequences set forth, respectively: SEQ ID NOs.: 703 and 705. In some embodiments, the polynucleotide or polynucleotides encode a first Fc region and a second Fc region, comprising amino acid sequences that are at least 95% identical to the amino acid sequences set forth, respectively: SEQ ID NOs.: 703 and 705. In some embodiments, the polynucleotide or polynucleotides encode a first Fc region and a second Fc region, comprising amino acid sequences that are at least 99% identical to the amino acid sequences set forth, respectively: SEQ ID NOs.: 703 and 705. In some embodiments, the polynucleotide or polynucleotides encode a first Fc region and a second Fc region, comprising amino acid sequences that are 100% identical to the amino acid sequences set forth, respectively: SEQ ID NOs.: 703 and 705.

In some embodiments, the polynucleotide or polynucleotides encode an unpaired heavy chain a Fab arm heavy chain and a Fab arm light chain as set forth in Table G. Illustrative polynucleotide sequences are provided in Table J. In some embodiments, the polynucleotide or polynucleotides encode an unpaired heavy chain a Fab arm heavy chain and a Fab arm light chain comprising amino acid sequences comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequences set forth, respectively: SEQ ID NOs: 995, 996 and 997; SEQ ID NOs: 998, 999 and 1000; SEQ ID NOs: 1001, 1002 and 1003; SEQ ID NOs: 1004, 1005 and 1000; SEQ ID NOs: 1006, 1002 and 997; SEQ ID NOs: 1007, 1093 and 1000; SEQ ID NOs: 998, 1008 and 1000; SEQ ID NOs: 998, 1009 and 1000; SEQ ID NOs: 1010, 1011 and 1012; SEQ ID NOs: 1013, 1014 and 1015; SEQ ID NOs: 1016, 1017 and 1012; SEQ ID NOs: 1018, 1019 and 1012; SEQ ID NOs: 1018, 1020 and 1012; SEQ ID NOs: 1021, 1022 and 1023; or SEQ ID NOs: 1024, 1025 and 1023.

In some embodiments, the polynucleotide or polynucleotides encode an unpaired heavy chain a Fab arm heavy chain and a Fab arm light chain comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequences set forth, respectively: SEQ ID NOs: 995, 996 and 997. In some embodiments, the polynucleotide or polynucleotides encode an unpaired heavy chain a Fab arm heavy chain and a Fab arm light chain comprising amino acid sequences that are at least 95% identical to the amino acid sequences set forth, respectively: SEQ ID NOs: 995, 996 and 997. In some embodiments, the polynucleotide or polynucleotides encode an unpaired heavy chain a Fab arm heavy chain and a Fab arm light chain comprising amino acid sequences that are at least 99% identical to the amino acid sequences set forth, respectively: SEQ ID NOs: 995, 996 and 997. In some embodiments, the polynucleotide or polynucleotides encode an unpaired heavy chain a Fab arm heavy chain and a Fab arm light chain comprising amino acid sequences that are 100% identical to the amino acid sequences set forth, respectively: SEQ ID NOs: 995, 996 and 997.

In some embodiments, the polynucleotide or polynucleotides encode an unpaired heavy chain a Fab arm heavy chain and a Fab arm light chain comprising amino acid sequences that are at least 80%, at least 85%, at least 90%, at least 91%, at least 92%, at least 93%, at least 94%, at least 95%, at least 96%, at least 97%, at least 98%, at least 99% identical, or is 100% identical, to the amino acid sequences set forth, respectively: SEQ ID NOs: 998, 999 and 1000. In some embodiments, the polynucleotide or polynucleotides encode an unpaired heavy chain a Fab arm heavy chain and a Fab arm light chain comprising amino acid sequences that are at least 95% identical to the amino acid sequences set forth, respectively: SEQ ID NOs: 998, 999 and 1000. In some embodiments, the polynucleotide or polynucleotides encode an unpaired heavy chain a Fab arm heavy chain and a Fab arm light chain comprising amino acid sequences that are at least 99% identical to the amino acid sequences set forth, respectively: SEQ ID NOs: 998, 999 and 1000. In some embodiments, the polynucleotide or polynucleotides encode an unpaired heavy chain a Fab arm heavy chain and a Fab arm light chain comprising amino acid sequences that are 100% identical to the amino acid sequences set forth, respectively: SEQ ID NOs: 998, 999 and 1000.

Also encompassed by this disclosure are polynucleotides encoding an anti-gp120 antigen binding molecule or antigen binding fragment thereof, or an anti-CD3 antigen binding domain or antigen binding fragment thereof, that have at least one of codon-biased sequences for improved expression in a desired host cell, replacement heterologous signal sequences, and reduced or eliminated mRNA instability elements. Methods to generate codon-biased nucleic acids can be carried out by adapting the methods described in, e.g., U.S. Pat. Nos. 5,965,726; 6,174,666; 6,291,664; 6,414,132; and 6,794,498. Preferred codon usage for expression of the multi-specific antigen binding molecules in desired host cells is provided, e.g., at kazusa.or.jp/codon/; and genscript.com/tools/codon-frequency-table.

As appropriate, in certain embodiments, the 3'-end of the polynucleotides encoding the multi-specific antigen binding molecules comprises one or multiple tandem stop codons, e.g., two or more tandem TAG ("amber"), TAA ("ochre") or TGA ("opal" or "umber") stop codons. The multiple tandem stop codons can be the same or different.

211

212

TABLE J polynucleotide encoding three chains of illustrative CD3/gp120-targeting bi-specific binding molecules

| Ab name | unpaired HC | Fab Arm - HC | Fab Arm - LC |
|---|---|---|---|
| 430 hCD4 D1.22 Fc AAS+ W + YTE/ huSP3 4.39.13 AAS + SAV + R | SEQ ID NO: 995<br>AAGAAAGTGGTGTACGGCAAAAAGGGCGACACC<br>GTGGAACTGACCTGTACCGCCAGCCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTCCAGACGGTCCCTGTGGGACCAGGGCAAC<br>TTTTCCACTGATCATCAAGAACCTGAAGCCTGAG<br>GACTCCGACACCTACATCTGCGAGGTGGAAGAT<br>CAGAAAGAAGAGGTGCAGCTGGTCGTCGTCGGA<br>GGATCTGACAAGACCCACACCTGTCCTCCATGT<br>CCTGCTCCAGAAGCTGCTGGCGGCCCTTCGTGT<br>TTCCTGTTTCCTCCAAAGCCTAAGGACACCCTG<br>TACATCACCCGCGAGCCTGAAGTGACCTGTGTG<br>GTGGTGGATGTGTCCCACGAGGATCCCGAAGTG<br>AAGTTCAATTGGTACGTGGACGGCGTGGAAGTG<br>CACAACGCCAAGACCAAGCCTAGAGAGGAACAG<br>TACAACAGCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCAGCATCGAGAAAACCATCAGCAAGGCC<br>AAGGGCCAGCCTAGGGAACCCCAGGTTTACACA<br>CTGCCTCCAAGCCGGGAAGAGATGACCAAGAAC<br>CAGGTGTCCCTGTGGTGCCTCGTGAAGGGCTTC<br>TACCCTTCCGATATCGCCGTGGAATGGGAGAGC<br>AATGGCCAGCCTGAGAACAACTACAAGACAACC<br>CCTCCTGTGCTGGACAGCGACGGCTCATTCTTC<br>CTGTACAGCAAGCTGACAGTGGACAAGTCCAGA<br>TGGCAGCAGGGCAACGTGTTCAGCTGCAGCGTG<br>ATGCACGAGGCCCTGCACAACCACTACACCCAG<br>AAGTCCCTGAGCCTGTCTCCTGGCAAA | SEQ ID NO: 996<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGGGCAGATTCACCATCTCTCGGGACGACTCC<br>AAGAACTCCCTGTACCTGGAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTCTTCCGCCTCTACAAAGGGCCCTAGT<br>GTGTTCCCTCTGGCTCCCAGCAGCAAGTCTACA<br>TCTGGCGGAACAGCCGCTCTGGGCTGCCTGGTC<br>AAGGATTACTTTCCCGAGCCTGTGACCGTGTCC<br>TGGAATTCTGGCGCTCTGACAAGCGGCGTGCAC<br>ACCTTTCCAGCTGTGCTGCAAAGCAGCGGCCTG<br>TACTCTCTGAGCAGCGTGGTCACAGTGCCTAGC<br>TCTAGCCTGGGCACCCAGACCTACATCTGCAAT<br>GTGAACCACAAGCCTAGCAACACCAAGGTGGAC<br>AAGAAGGTGGAACCCAAGAGCTGCGACAAGACC<br>CACACCTGTCCTCCATGTCCTGCTGCCAGCACC<br>GCTGGCGGCCCTTCCGTGTTTCTGTTCCCTCCA<br>AAGCCTAAGGACACCCTGATGATCAGCAGAACC<br>CCTGAAGTGACCTGCGTGGTGGTGGATGTGTCC<br>CACGAGGATCCCGAAGTGAAGTTCAATTGGTAC<br>GTGGACGGCGTGGAAGTGCACAACGCCAAGACC<br>AAGCCTAGAGAGGAACAGTACAACAGCACCTAC<br>AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCAGCATCGAG<br>AAAACCATCAGCAAGGCCAAGGGCCAGCCTAGG<br>GAACCCCAGGTTTACACACTGCCTCCAAGCCGG<br>GAAGAGATGACCAAGAACCAGGTGTCCCTGAGC<br>TGTGCCGTGAAGGGCTTCTACCCTTCCGATATC<br>GCCGTGGAATGGGAGAGCAATGGCCAGCCTGAG<br>AACAACTACAAGACAACCCCTCCTGTGCTGGAC<br>AGCGACGGCTCATTCTTCCTGGTGTCCAAGCTG<br>ACAGTGGACAAGTCCAGATGGCAGCAGGGCAAC<br>GTGTTCAGCTGCAGCGTGATGCACGAGGCCCTG<br>CACAACCGGTACACCCAGAAGTCCCTGTCTCTG<br>AGCCCCGGCAAA | SEQ ID NO: 997<br>CAAGCTGTTGTGACAC<br>AAGAGCCCAGCCTGAC<br>AGTGTCTCCTGGCGGA<br>ACAGTGACACTGACCT<br>GTGGATCTTCTACAGG<br>CGCCGTGACAACCGGC<br>CACTATGCTAATTGGG<br>TGCAGCAGAAACCCGG<br>ACAGGCCCCTAGAGGA<br>CTGATCGGCGGAACAT<br>CTAATAGAGCCCCTGG<br>CGTGCCAGCCAGATTT<br>TCTGGATCTCTGCTCG<br>GAGGCAAGGCCGCTCT<br>GACAATTCTGGCGCC<br>CAGCCAGAGGATGAGG<br>CCGAGTATTATTGTGC<br>CCTGTGGTACAGCAAC<br>AGATGGGTGTTCGGCG<br>GAGGCACCAAACTGAC<br>AGTGCTGGGACAACCT<br>AAGGCTGCCCCTAGCG<br>TGACACTGTTTCCTCC<br>AAGCTCTGAGGAACTC<br>CAGGCCAACAAGGCCA<br>CACTCGTGTGCCTGAT<br>CAGCGATTTTTACCCT<br>GGCGCTGTGACAGTGG<br>CCTGGAAGGCTGATAG<br>CTCCTCCTGTGAAAGCC<br>GGCGTGGAAACCACCA<br>CACCTAGCAAGCAGAG<br>CAACAACAAATACGCC<br>GCCAGCAGCTACCTGA<br>GCCTGACACCTGAGCA<br>GTGGAAGTCCCACAGA<br>TCCTACAGCTGCCAAG<br>TGACCCACGAGGGCAG<br>CACCGTGGAAAAAACA<br>GTGGCCCCTACCGAGT<br>GCAGC |
| 431 hCD4 D1.22 Fc AAS + W + YTE/ huSP3 4.39.13 AAS + SAV + R | SEQ ID NO: 998<br>AAAAAGGTGGTGTACGGCAAGAAGGGCGACACC<br>GTCGAGCTGACCTGTACCGCCTCTCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTCCAGACGGTCCCTGTGGGACCAGGGCAAC<br>TTTTCCACTGATCATCAAGAACCTGAAGCCTGAG<br>GACTCCGACACCTACATCTGCGAGGTGGAAGAT<br>CAGAAAGAAGAGGTGCAGCTGGTCGTCGTCGGC<br>GGCTCTGATAAGACCCATACCTGTCCTCCATGT<br>CCTGCTCCAGAAGCTGCTGGCGGCCCTTCCGTG<br>TTTCTGTTTCCTCCAAAGCCTAAGGACACCCTG<br>TACATCACCCGCGAGCCTGAAGTGACCTGCGTG<br>GTGGTGGATGTGTCTCACGAGGACCCCGAAGTG<br>AAGTTCAATTGGTACGTGGACGGCGTGGAAGTG<br>CACAACGCCAAGACCAAGCCTAGAGAAGAGCAG<br>TACAACTCCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCTCCATCGAAAAGACCATCTCCAAGGCC<br>AAGGGCCAGCCTAGGGAACCCCAGGTTTACACC<br>CTGCCACCTAGCCGGGAAGAGATGACCAAGAAC<br>CAGGTGTCACTGTGGTGCCTGGTCAAGGGCTTC<br>TACCCCTCTGATATCGCCGTGGAATGGGAGAGC<br>AATGGCCAGCCTGAGAACAACTACAAGACCACA<br>CCTCCTGTGCTGGACAGCGACGGCTCATTCTTC<br>CTGTACAGCAAGCTGACAGTGGACAAGTCCAGA | SEQ ID NO: 999<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCT<br>ATGAACTGGGTCCGACAGGCCCCTGGCAAAGGA<br>CTGGAATGGGTCGGACGGATCCGGTCCAAGTAC<br>AACAATTACGCCACCTACTACGCCGACTCCGTG<br>AAGTCCCGGTTCACCATCTCTCGGGACGACTCC<br>AAGAACTCCCTGTACCTGGAAATGAACAGCCTG<br>CGGACCGAGGACACCGCCGTGTATTATTGTGTG<br>CGGCACGGCAACTTCGGCCACTCCTATGTGTCT<br>TGGTTTGCCTACTGGGGCCAGGGCACACTGGTC<br>ACAGTTCTTCCGCCTCCACCAAGGGACCCAGC<br>GTGTTCCCTCTGGCTCCATCCTCCAAGTCTACC<br>TCTGGCGGAACAGCTGCTCTGGGCTGCCTGGTC<br>AAGGACTACTTTCCTGAGCCTGTGACCGTGTCC<br>TGGAACTCTGGCGCTCTGACATCGGCGTGCAC<br>ACCTTTCCAGCTGTGCTGCAGTCCTCCGGCCTG<br>TACTCTCTGTCCTCTGTCGTGACCGTGCCTTCC<br>AGCTCTCTGGGAACCCAGACCTACATCTGCAAT<br>GTGAACCACAAGCCTTCCAACACCAAGGTGGAC<br>AAGAAGGTGGAACCCAAGAGCTGCGACAAGACC<br>CACACCTGTCCTCCATGTCCTGCTCCAGAAGCT<br>GCTGGCGGCCCTTCCGTGTTTCTGTTCCCTCCA<br>AAGCCTAAGGACACCCTGATGATCTCTCGGACC<br>CCTGAAGTGACCTGCGTGGTGGTGGATGTGTCT<br>CACGAGGATCCCGAAGTGAAGTTCAATTGGTAC<br>GTGGACGGCGTGGAAGTGCACAACGCCAAGACC | SEQ ID NO: 1000<br>CAGGCCGTGGTCACCC<br>AAGAGCCTAGCCTGAC<br>AGTTTCTCCTGGCGGC<br>ACCGTGACACTGACCT<br>GTGGATCTTCTACCGG<br>CGCTGTGACCACCGGC<br>CACTACGCTAATTGGG<br>TGCAGCAGAAGCCTGG<br>ACAGGCTCCCAGAGGA<br>CTGATCGGCGGCACCT<br>CTAATAGAGCACCTGG<br>CGTGCCAGCCAGATTC<br>TCCGGATCTCTGCTTG<br>GCGGAAAGGCCGCTCT<br>GACAATCTCTGGTGCT<br>CAGCCTGAGGACGAGG<br>CCGAGTACTATTGTGC<br>CCTGTGGTACTCCAAC<br>AGATGGGTGTTCGGCG<br>GAGGCACCAAGCTGAC<br>AGTTCTGGGACAGCCT<br>AAGGCTGCCCCTTCCG<br>TGACTCTGTTCCCTCC<br>ATCCTCTGAGGAACTG<br>CAGGCCAACAAGGCTA<br>CCCTCGTGTGCCTGAT<br>CTCCGACTTTTACCCT |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | TGGCAGCAGGGCAACGTGTTCTCCTGCTCCGTG<br>ATGCACGAGGCCCTGCACAATCACTACACCCAG<br>AAGTCCCTGTCTCTGTCCCCTGGCAAA | AAGCCTAGAGAGGAACAGTACAACTCCACCTAC<br>AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCTCCATCGAA<br>AAGACCATCTCCAAGGCCAAGGGCCAGCCTAGG<br>GAACCCCAGGTTTACACCCTGCCCACCTAGCCGG<br>GAAGAGATGACCAAGAACCAGGTGTCCCTGTCC<br>TGTGCCGTGAAGGGCTTCTACCCTTCCGATATC<br>GCCGTGGAATGGGAGAGCAATGGCCAGCCTGAG<br>AACAACTACAAGACAACCCCTCCTGTGCTGGAC<br>TCCGACGGCTCATTCTTCCTGGTGTCCAAGCTG<br>ACAGTGGACAAGTCTAGATGGCAGCAGGGCAAC<br>GTGTTCTCCTGCTCCGTGATGCACGAGGCCCTG<br>CACAACAGATACACCCAGAAGTCCCTGTCTCTG<br>AGCCCCGGAAAA | GGCGCCGTGACCGTGG<br>CTTGGAAGGCTGATAG<br>TTCTCCTGTGAAGGCC<br>GGCGTGGAAACCACCA<br>CACCTAGCAAGCAGTC<br>CAACAACAAATACGCC<br>GCCTCCTCCTACCTGT<br>CTCTGACCCCTGAACA<br>GTGGAAGTCCCACCGG<br>TCCTACAGCTGCCAAG<br>TGACCCATGAGGGCTC<br>CACCGTGGAAAAGACA<br>GTGGCCCCTACCGAGT<br>GCTCT |
| 432<br>hCD4<br>D1.22<br>Fc<br>AAS +<br>SAV + R/<br>huSP3<br>4.3.13<br>AAS + W +<br>YTE | SEQ ID NO: 1001<br>AAGAAAGTGGTGTACGGCAAAAAGGGCGACACC<br>GTGGAACTGACCTGTACCGCCAGCCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTCCAGACGGTCCCTGTGGGACCAGGGCAAC<br>TTTCCACTGATCATCAAGAACCTGAAGCCTGAG<br>GACTCCGACACCTACATCTGCGAGGTGGAAGAT<br>CAGAAGAAGAGGTGCAGCTGGTCGTCGTCGGA<br>GGATCTGACAAGACCCACACCTGTCCTCCATGT<br>CCTGCTCCAGAAGCTGCTGGCGGCCCTTCCGTG<br>TTTCTGTTCCCTCCAAAGCCTAAGGACACCCTG<br>ATGATCAGCAGAACCCCTGAAGTGACCTGCGTG<br>GTGGTGGATGTGTCCCACGAGGATCCCGAAGTG<br>AAGTTCAATTGGTACGTGGACGGCGTGGAAGTG<br>CACAACGCCAAGACCAAGCCTAGAGAGGAACAG<br>TACAACAGCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCAGCATCGAGAAAACCATCAGCAAGGCC<br>AAGGGCCAGCCTAGGGAACCCCAGGTTTACACA<br>CTGCCTCCAAGCCGGGAAGAGATGACCAAGAAC<br>CAGGTGTCCCTGACCTGTGCCGTGAAGGGCTTC<br>TACCCTTCCGATATCGCCGTGGAATGGGAGAGC<br>AATGGCCAGCCTGAGAACAACTACAAGACAACC<br>CCTCCTGTGCTGGACAGCGACGGCTCATTCTTC<br>CTGGTGTCCAAGCTGACAGTGGACAAGTCCAGA<br>TGGCAGCAGGGCAACGTGTTCAGCTGCAGCGTG<br>ATGCACGAGGCCCTGCACAACCGGTACACCCAG<br>AAGTCCCTGTCTCTGAGCCCCGGCAAA | SEQ ID NO: 1002<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGGGCAGATTCACCATCTCTCGGGACGACTCC<br>AAGAACACCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTCTTCCGCTAGCACCAAGGGCCCCTCC<br>GTGTTTCCACTGGCTCCAGCAGCAAGAGCACA<br>AGCGGAGGAACAGCCGCTCTGGGCTGTCTGGTC<br>AAGGACTACTTTCCCGAGCCTGTGACCGTGTCC<br>TGGAATTCTGGCGCTCTGACAAGCGGCGTGCAC<br>ACCTTTCCAGCTGTGCTGCAAAGCAGCGGCCTG<br>TACTCTCTGAGCAGCGTGGTCACAGTGCCAAGC<br>TCTAGCCTGGGCACCCAGACCTACATCTGCAAT<br>GTGAACCACAAGCCTAGCAACACCAAGGTGGAC<br>AAGAAGGTGGAACCCAAGAGCTGCGACAAGACC<br>CACACCTGTCCTCCATGTCCTGCTCCAGAAGCT<br>GCTGGCGCCCTTCTGTGTTCCTGTTTCCTCCA<br>AAGCCTAAGGACACCCTGTACATCACCCGCGAG<br>CCTGAAGTGACCTGTGTGGTGGTGGATGTGTCC<br>CACGAGGACCCCGAAGTGAAGTTCAATTGGTAC<br>GTGGACGGCGTGGAAGTGCACAACGCCAAGACC<br>AAGCCTAGAGAGGAACAGTACAACAGCACCTAC<br>AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCAGCATCGAG<br>AAAACCATCAGCAAGGCCAAGGGCCAGCCTAGG<br>GAACCCCAGGTTTACACACTGCCTCCAAGCCGG<br>GAAGAGATGACCAAGAACCAGGTGTCCCTGTGG<br>TGCCTGTGAAGGGCTTCTACCCTTCCGATATC<br>GCCGTGGAATGGGAGAGCAATGGCCAGCCTGAG<br>AACAACTACAAGACAACCCCTCCTGTGCTGGAC<br>AGCGACGGCTCATTCTTCCTGTACAGCAAGCTG<br>ACAGTGGACAAGTCCAGATGGCAGCAGGGCAAC<br>GTGTTCAGCTGCAGCGTGATGCACGAGGCCCTG<br>CACAACCACTACACCCAGAAGTCCCTGAGCCTG<br>TCTCCTGGCAAA | SEQ ID NO: 1003<br>CAAGCTGTTGTGACAC<br>AAGAGCCCAGCCTGAC<br>AGTGTCTCCTGGCGGA<br>ACAGTCTGACACTGACCT<br>GTGGATCTTCTACAGG<br>CGCCGTGACAACCGGC<br>CACTATGCTAATTGGG<br>TGCAGCAGAAACCCGG<br>ACAGGCCCCTAGAGGA<br>CTGATCGGCGGAACAT<br>CTAATAGAGCCCCTGG<br>CGTGCCAGCCAGATTT<br>TCTGCCGAGTATTATT<br>GTGCCCTGTGGTACAG<br>CAACAGATGGGTGTTC<br>GGCGGAGGCACCAAAC<br>TGACAGTGCTGGGACA<br>ACCTAAGGCTGCCCCT<br>AGCGTGACACTGTTTC<br>CTCCAAGCTCTGAGGA<br>ACTCCAGGCCAACAAG<br>GCCACACTCGTGTGCC<br>TGATCAGCGATTTTTA<br>CCCTGGCGCTGTGACA<br>GTGGCCTGGAAGGCTG<br>ATAGCTCTCCTGTGAA<br>AGCCGGCGTGGAAACC<br>ACCACACCTAGCAAGC<br>AGAGCAACAACAAATA<br>CGCCGCCAGCAGCTAC<br>CTGAGCCTGACACCTG<br>AGCAGTGGAAGTCCCA<br>CAGATCCTACAGCTGC<br>CAAGTGACCCACGAGG<br>GCAGCACCGTGGAAAA<br>AACAGTGGCCCCTACC<br>GAGTGCAGC |
| 433<br>hCD4<br>D1.22<br>Fc<br>AAS +<br>SAV + R/<br>huSP3<br>4.3.13<br>AAS +<br>W + YTE | SEQ ID NO: 1004<br>AAAAAGGTGGTGTACGGCAAGAAGGGCGACACC<br>GTCGAGCTGACCTGTACCGCCTCTCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTCCAGACGGTCCCTGTGGGACCAGGGCAAC<br>TTTCCACTGATCATCAAGAACCTGAAGCCTGAG<br>GACTCCGACACCTACATCTGCGAGGTGGAAGAT<br>CAGAAGAAGAGGTGCAGCTGGTCGTCGTCGGC<br>GGCTCTGATAAGACCCATACCTGTCCTCCATGT<br>CCTGCTCCAGAAGCTGCTGGCGGCCCTTCCGTG<br>TTTCTGTTCCCTCCAAAGCCTAAGGACACCCTG<br>ATGATCTCCGGACCCCTGAAGTGACCTGCGTG | SEQ ID NO: 1005<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCT<br>ATGAACTGGGTCCGACAGGCCCCTGGCAAAGGC<br>CTGGAATGGGTCGGACGGATCCGGTCCAAGTAC<br>AACAACTACGCCACCTACTACGCCGACTCCGTG<br>AAGGGCAGATTCACCATCTCTCGGGACGACTCC<br>AAGAACACCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTCTTCCGCCTCCACCAAGGGACCCAGC<br>GTTTCCCTCTGGCTCCATCCTCCAAGTCTACC | SEQ ID NO: 1000<br>CAGGCCGTGGTCACCC<br>AAGAGCCTAGCCTGAC<br>AGTTTCTCCTGGCGGC<br>ACCGTGACACTGACCT<br>GTGGATCTTCTACCGG<br>CGCTGTGACCACCGGC<br>CACTACGCTAATTGGG<br>TGCAGCAGAAGCCTGG<br>ACAGGCTCCCAGAGGA<br>CTGATCGGCGGCACCT<br>AATAGAGCACCTGG<br>CGTGCCAGCCAGATTC<br>TCCGGATCTCTGCTTG |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | GTGGTGGATGTGTCTCACGAGGATCCCGAAGTG<br>AAGTTCAATTGGTACGTGGACGGCGTGGAAGTG<br>CACAACGCCAAGACCAAGCCTAGAGAGGAACAG<br>TACAACTCCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCTCCATCGAAAAGACCATCTCCAAGGCC<br>AAGGGCCAGCCTAGGGAACCCCAGGTTTACACC<br>CTGCCACCTAGCCGGGAAGAGATGACCAAGAAC<br>CAGGTGTCCCTGTCCTGTGCCGTGAAGGGCTTC<br>TACCCTTCCGATATCGCCGTGGAATGGGAGAGC<br>AATGGCCAGCCTGAGAACAACTACAAGACCACA<br>CCTCCTGTGCTGGACAGCGACGGCTCATTCTTC<br>CTGGTGTCTAAGCTGACAGTGGACAAGTCCAGA<br>TGGCAGCAGGGCAACGTGTTCTCCTGCTCCGTG<br>ATGCACGAGGCCCTGCACAACCAGATACACCCAG<br>AAGTCCCTGAGCCTGTCTCCTGGCAAA | TCTGGCGGAACATGGAACTCTGGCGCTCTGACA<br>TCTGGCGTGCACACCTTTCCAGCTGTGCTGCAG<br>TCCTCCGGCCTGTACTCTCTGTCCTCTGTCGTG<br>ACCGTGCCTTCCAGCTCTCTGGGAACCCAGACC<br>TACATCTGCAATGTGAACCACAAGCCTTCCAAC<br>ACCAAGGTGGACAAGAAGGTGGAACCCAAGTCC<br>TGCGACAAGACCCACACCTGTCCTCCATGTCCT<br>GCTCCAGAAGCTGCTGGCGGCCCTTCCGTGTTT<br>CTGTTCCCTCCAAAGCCTAAGGACACCCTGTAC<br>ATCACCCGCGAGCCTGAAGTGACCTGCGTGGTG<br>GTGGATGTGTCTCACGAGGACCCCGAAGTGAAG<br>TTCAATTGGTACGTGGACGGCGTGGAAGTGCAC<br>AACGCCAAGACCAAGCCTAGAGAGGAACAGTAC<br>AACTCCACCTACAGAGTGGTGTCCGTGCTGACC<br>GTGCTGCACCAGGATTGGCTGAACGGCAAAGAG<br>TACAAGTGCAAGGTGTCCAACAAGGCCCTGCCT<br>GCCTCCATCGAAAAGACCATCTCCAAGGCCAAG<br>GGCCAGCCTAGGGAACCCCAGGTTTACACCCTG<br>CCACCTAGCCGGGAAGAGATGACCAAGAACCAG<br>GTGTCCCTGTGGTGCCTGGTTAAGGGCTTCTAC<br>CCCTCCGATATCGCCGTGGAATGGGAGTCTAAT<br>GGCCAGCCTGAGAACAACTACAAGACAACCCCT<br>CCTGTGCTGGACTCCGACGGCTCATTCTTCCTG<br>TACTCCAAGCTGACAGTGGACAAGTCCAGATG<br>CAGCAGGGCAACGTGTTCTCCTGCTCCGTGATG<br>CACGAGGCCCTGCACAATCACTACACCCAGAAG<br>TCCCTGTCTCTGAGCCCTGGCAAG | GCGGAAAGGCCGCTCT<br>GACAATCTCTGGTGCT<br>CAGCCTGAGGACGAGG<br>CCGAGTACTATTGTGC<br>CCTGTGGTACTCCAAC<br>AGATGGGTGTTCGGCG<br>GAGGCACCAAGCTGAC<br>AGTTCTGGGACAGCCT<br>AAGGCTGCCCCTTCCG<br>TGACTCTGTTCCCTCC<br>ATCCTCTGAGGAACTG<br>CAGGCCAACAAGGCTA<br>CCCTCGTGTGCCTGAT<br>CTCCGACTTTTACCCT<br>GGCGCCGTGACCGTGG<br>CTTGGAAGGCTGATAG<br>TTCTCCTGTGAAGGCC<br>GGCGTGGAAACCACCA<br>CACCTAGCAAGCAGTC<br>CAACAACAAATACGCC<br>GCCTCCTCCTACCTGT<br>CTCTGACCCCTGAACA<br>GTGGAAGTCCCACCGG<br>TCCTACAGCTGCCAAG<br>TGACCCATGAGGGCTC<br>CACCGTGGAAAAGACA<br>GTGGCCCCTACCGAGT<br>GCTCT |
| 434<br>hCD4<br>D1.22<br>Fc<br>AAS +<br>SAV +<br>YTE/huS<br>P34.3.13<br>AAS + W +<br>YTE | SEQ ID NO: 1006<br>AAGAAAGTGGTGTACGGCAAAAAGGGCGACACC<br>GTGGAACTGACCTGTACCGCCAGCCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTTCAGACGCTCCGTGGGACCAGGGCAAC<br>TTTCCACTGATCATCAAGAACCTGAAGCCTGAG<br>GACTCCGACACCTACATCTGCGAGGTGGAAGAT<br>CAGAAAGAAGAGGTGCAGCTGGTCGTCGTCGGA<br>GGATCTGACAAGACCCACACCTGTCCTCCATGT<br>CCTGCTCCAGAAGCTGCTGGCGGCCCTTCCGTG<br>TTTCTGTTCCCTCCAAAGCCTAAGGACACCCTG<br>TACATCACCCGCGAGCCTGAAGTGACCTGCGTG<br>GTGGTGGATGTGTCCCACGAGGATCCCGAAGTG<br>AAGTTCAATTGGTACGTGGACGGCGTGGAAGTG<br>CACAACGCCAAGACCAAGCCTAGAGAGGAACAG<br>TACAACAGCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCAGCATCGAGAAACCATCAGCAAGGCC<br>AAGGGCCAGCCTAGGGAACCCCAGGTTTACACA<br>CTGCCTCCAAGCCGGGAAGAGATGACCAAGAAC<br>CAGGTGTCCCTGAGCTGTGCCGTGAAGGGCTTC<br>TACCCTTCCGATATCGCCGTGGAATGGGAGAGC<br>AATGGCCAGCCTGAGAACAACTACAAGACAACC<br>CCTCCTGTGCTGGACAGCGACGGCTCATTCTTC<br>CTGGTGTCCAAGCTGACAGTGGACAAGTCCAGA<br>TGGCAGCAGGGCAACGTGTTCAGCTGCAGCGTG<br>ATGCACGAGGCCCTGCACAACCACTACACCCAG<br>AAGTCCCTGTCTCTGAGCCCCGGCAAA | SEQ ID NO: 1002<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACACCACCTACTACGCCGACTCCGTG<br>AAGGGCAGATTCACCATCTCTCGGGACGACTCC<br>AAGAACTCCCTGTACCTGCAGATGAACAGCCTG<br>CGGACCGAGGATACCGCCGTGTACTATTGTGTG<br>CGGCACGGCAACTTCGGCCACTCCTATGGTCCT<br>TGGTTTGCCTACTGGGGCCAGGGCACACTGGTC<br>ACAGTTTCTTCCGCTAGCACCAAGGGCCCCTCC<br>GTGTTTCCACTGGCTCCTAGCAGCAAGAGCACA<br>AGCGGAGGAACAGCCGCTCTGGGCTGTCTGGTC<br>AAGGACTACTTCCCCGAGCCTGTGACCGTGTCC<br>TGGAATTCTGGCGCTCTGACAAGCGGCGTGCAC<br>ACCTTTCCAGCTGTGCTGCAAAGCAGCGGCCTG<br>TACTCTCTGAGCAGCGTGGTCACAGTGCCAAGC<br>TCTAGCCTGGGCACCCAGACCTACATCTGCAAT<br>GTGAACCACAAGCCTAGCAACACCAAGGTGGAC<br>AAGAGAGTGGAACCCAAGAGCTGCGACAAGACC<br>CACACCTGTCCTCCATGTCCTGCTCCAGAAGCT<br>GCTGGCGGCCCTTCTGTGTTCCTGTTTCCTCCA<br>AAGCCTAAGGACACCCTGTACATCACCCGCGAG<br>CCTGAAGTGACCTGTGTGGTGGTGGATGTGTCC<br>CACGAGGACCCCGAAGTGAAGTTCAATTGGTAC<br>GTGGACGGCGTGGAAGTGCACAACGCCAAGACC<br>AAGCCTAGAGAGGAACAGTACAACAGCACCTAC<br>AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCAGCATCGAG<br>AAACCATCAGCAAGGCCAAGGGCCAGCCTAGG<br>GAACCCCAGGTTTACACACTGCCTCCAAGCCGG<br>GAAGAGATGACCAAGAACCAGGTGTCCCTGTGG<br>TGCCTCGTGAAGGGCTTCTACCCTTCCGATATC<br>GCCGTGGAATGGGAGAGCAATGGCCAGCCTGAG<br>AACAACTACAAGACAACCCCTCCTGTGCTGGAC<br>AGCGACGGCTCATTCTTCCTGTACAGCAAGCTG<br>ACAGTGGACAAGTCCAGATGGCAGCAGGGCAAC<br>GTGTTCAGCTGCAGCGTGATGCACGAGGCCCTG<br>CACAACCACTACACCCAGAAGTCCCTGAGCCTG<br>TCTCCTGGCAAA | SEQ ID NO: 997<br>CAAGCTGTTGTGACAC<br>AAGAGCCCAGCTGAC<br>AGTGTCTCCTGGCGGA<br>ACAGTGACACTGACCT<br>GTGGATCTTCTACAGG<br>CGCCGTGACAACCGGC<br>CACTATGCTAATTGGG<br>TGCAGCAGAAACCCGG<br>ACAGGCCCCTAGAGGA<br>CTGATCGGCGGAACAT<br>CTAATAGAGCCCCTGG<br>CGTGCCAGCCAGATTT<br>TCTGGATCTCTGCTCG<br>GAGGCAAGGCCGCTCT<br>GACAATTTCTGGCGCC<br>CAGCCAGAGGATGAGG<br>CCGAGTATTATTGTGC<br>CCTGTGGTACAGCAAC<br>AGATGGGTGTTCGGCG<br>GAGGCACCAAACTGAC<br>AGTGCTGGGACAACCT<br>AAGGCTGCCCCTAGCG<br>TGACACTGTTTCCTCC<br>AAGCTCTGAGGAACTC<br>CAGGCCAACAAGGCCA<br>CACTCGTGTGCCTGAT<br>CAGCGATTTTTACCCT<br>GGCGCTGTGACAGTGG<br>CCTGGAAGGCTGATAG<br>CTCCTGTGAAAGCC<br>GGCGTGGAAACCACCA<br>CACCTAGCAAGCAGAG<br>CAACAACAAATACGCC<br>GCCAGCAGCTACCTGA<br>GCCTGACACCTGAGCA<br>GTGGAAGTCCCACAGA<br>TCCTACAGCTGCCAAG<br>TGACCCACGAGGGCAG<br>CACCGTGGAAAAAACA<br>GTGGCCCCTACCGAGT<br>GCAGC |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| 435 hCD4 D1.22 Fc AAS + SAV + YTE/hus P34.3.13 AAS + W + YTE | SEQ ID NO: 1007 AAAAAGGTGGTGTACGGCAAGAAGGGCGACACC GTCGAGCTGACCTGTACCGCCTCTCAGAAGAAG AACATCCAGTTCCACTGGAAGAACTCCAACCAG ATCAAGATCCTGGGCAACCAGGGCAGCTTCCTG ACCAAGGGACCTTCCAAGCTGAACGACAGAGTG GACTCCAGACGGTCCCTGTGGGACCAGGGCAAC TTTCCACTGATCATCAAGAACCTGAAGCCTGAG GACTCCGACACCTACATCTGCGAGGTGGAAGAT CAGAAAGAAGAGGTGCAGCTGGTCGTCGTCGGC GGCTCTGATAAGACCCATACCTGTCCTCCATGT CCTGCTCCAGAAGCTGCTGGCGGCCCTTCCGTG TTTCTGTTCCCTCCAAAGCCTAAGGACACCCTG TACATCACCCGCGAGCCTGAAGTGACCTGCGTG GTGGTGGATGTGTCTCACGAGGACCCCGAAGTG AAGTTCAATTGGTACGTGGACGGCGTGGAAGTG CACAACGCCAAGACCAAGCCTAGAGAGGAACAG TACAACTCCACCTACAGAGTGGTGTCCGTGCTG ACCGTGCTGCACCAGGATTGGCTGAACGGCAAA GAGTACAAGTGCAAGGTGTCCAACAAGGCCCTG CCTGCCTCCATCGAAAAGACCATCTCCAAGGCC AAGGGCCAGCCTAGGGAACCCCAGGTTTACACC CTGCCACCTAGCCGGGAAGAGATGACCAAGAAC CAGGTGTCCCTGTCCTGTGCCGTGAAGGGCTTC TACCCTTCCGATATCGCCGTGGAATGGGAGAGC AATGGCCAGCCTGAGAACAACTACAAGACCACA CCTCCTGTGCTGGACAGCGACGGCTCATTCTTC CTGGTGTCTAAGCTGACAGTGGACAAGTCCAGA TGGCAGCAGGGCAACGTGTTCTCCTGCTCCGTG ATGCACGAGGCCCTGCACAATCACTACACCCAG AAGTCCCTGAGCCTGTCTCCTGGCAAA | SEQ ID NO: 1093 GAGGTGCAGCTGGTGGAATCTGGCGGAGGATTG GTTCAGCCTGGCGGCTCTCTGAGACTGTCTTGT GCCGCTTCTGGCTTCACCTTCAACACCTACGCT ATGAACTGGGTCCGACAGGCCCCTGGCAAAGGA CTGGAATGGGTCGGACGGATCCGGTCCAAGTAC AACAACTACGCCACCTACTACGCCGACTCCGTG AAGGGCAGATTCACCATCTCTCGGGACGACTCC AAGAACTCCCTGTACCTGCAGATGAACAGCCTG CGGACCGAGGATACCGCCGTGTACTATTGTGTG CGGCACGGCAACTTCGGCCACTCCTATGTGTCT TGGTTTGCCTACTGGGGCCAGGGCACACTGGTC ACAGTTTCTTCCGCCTCCACCAAGGGACCCAGC GTTTTCCCTCTGGCTCCATCCTCCAAGTCTACC TCTGGCGGAACAGCTGCTCTGGGCTGCCTGGTC AAGGACTACTTTCCTGAGCCTGTGACCGTGTCC TGGAACTCTGGCGCTCTGACATCTGGCGTGCAC ACCTTTCCAGCTGTGCTGCAGTCCTCCGGCCTG TACTCTCTGTCCTCTGTCGTGACCGTGCCTTCC AGCTCTCTGGGAACCCAGACCTACATCTGCAAT GTGAACCACAAGCCTTCCAACACCAAGGTGGAC AAGAAGGTGGAACCCAAGTCCTGCGACAAGACC CACACCTGTCCTCCATGTCCTGCTCCAGAAGCT GCTGGCGGCCCTTCCGTGTTTCTGTTCCCTCCA AAGCCTAAGGACACCCTGTACATCACCCGCGAG CCTGAAGTGACCTGCGTGGTGGTGGATGTGTCT CACGAGGACCCCGAAGTGAAGTTCAATTGGTAC GTGGACGGCGTGGAAGTGCACAACGCCAAGACC AAGCCTAGAGAGGAACAGTACAACTCCACCTAC AGAGTGGTGTCCGTGCTGACCGTGCTGCACCAG GATTGGCTGAACGGCAAAGAGTACAAGTGCAAG GTGTCCAACAAGGCCCTGCCTGCCTCCATCGAA AAGACCATCTCCAAGGCCAAGGGCCAGCCTAGG GAACCCCAGGTTTACACCCTGCCACCTAGCCGG GAAGAGATGACCAAGAACCAGGTGTCCCTGTGG TGCCTGGTTAAGGGCTTCTACCCCTCCGATATC GCCGTGGAATGGGAGTCTAATGGCCAGCCTGAG AACAACTACAAGACAACCCCTCCTGTGCTGGAC TCCGACGGCTCATTCTTCCTGTACTCCAAGCTG ACAGTGGACAAGTCCAGATGGCAGCAGGGCAAC GTGTTCTCCTGCTCCGTGATGCACGAGGCCCTG CACAATCACTACACCCAGAAGTCCCTGTCTCTG AGCCCTGGCAAG | SEQ ID NO: 1000 CAGGCCGTGGTCACCC AAGAGCCTAGCCTGAC AGTTTCTCCTGGCGGC ACCGTGACACTGACCT GTGGATCTTCTACCGG CGCTGTGACCACCGGC CACTACGCTAATTGGG TGCAGCAGAAGCCTGG ACAGGCTCCCAGAGGA CTGATCGGCGGCACCT CTAATAGAGCACCTGG CGTGCCAGCCAGATTC TCCGGATCTCTGCTTG GCGGAAAGGCCGCTCT GACAATCTCTGGTGCT CAGCCTGAGGACGAGG CCGAGTACTATTGTGC CCTGTGGTACTCCAAC AGATGGGTGTTCGGCG GAGGCACCAAGCTGAC AGTTCTGGGACAGCCT AAGGCTGCCCCTTCCG TGACTCTGTTCCCTCC ATCCTCTGAGGAACTG CAGGCCAACAAGGCTA CCCTCGTGTGCCTGAT CTCCGACTTTTACCCT GGCGCCGTGACCGTGG CTTGGAAGGCTGATAG TTCTCCTGTGAAGGCC GGCGTGGAAACCACCA CACCTAGCAAGCAGTC CAACAACAAATACGCC GCCTCCTCCTACCTGT CTCTGACCCCTGAACA GTGGAAGTCCCACCGG TCCTACAGCTGCCAAG TGACCCATGAGGGCTC CACCGTGGAAAAGACA GTGGCCCCTACCGAGT GCTCT |
| 436 hCD4 D1.22 Fc AAS + W + YTE/ huSP3 4.40.13 AAS + SAV + R | SEQ ID NO: 998 AAAAAGGTGGTGTACGGCAAGAAGGGCGACACC GTCGAGCTGACCTGTACCGCCTCTCAGAAGAAG AACATCCAGTTCCACTGGAAGAACTCCAACCAG ATCAAGATCCTGGGCAACCAGGGCAGCTTCCTG ACCAAGGGACCTTCCAAGCTGAACGACAGAGTG GACTCCAGACGGTCCCTGTGGGACCAGGGCAAC TTTCCACTGATCATCAAGAACCTGAAGCCTGAG GACTCCGACACCTACATCTGCGAGGTGGAAGAT CAGAAAGAAGAGGTGCAGCTGGTCGTCGTCGGC GGCTCTGATAAGACCCATACCTGTCCTCCATGT CCTGCTCCAGAAGCTGCTGGCGGCCCTTCCGTG TTTCTGTTCCCTCCAAAGCCTAAGGACACCCTG TACATCACCCGCGAGCCTGAAGTGACCTGCGTG GTGGTGGATGTGTCTCACGAGGACCCCGAAGTG AAGTTCAATTGGTACGTGGACGGCGTGGAAGTG CACAACGCCAAGACCAAGCCTAGAGAGGAACAG TACAACTCCACCTACAGAGTGGTGTCCGTGCTG ACCGTGCTGCACCAGGATTGGCTGAACGGCAAA GAGTACAAGTGCAAGGTGTCCAACAAGGCCCTG CCTGCCTCCATCGAAAAGACCATCTCCAAGGCC AAGGGCCAGCCTAGGGAACCCCAGGTTTACACC CTGCCACCTAGCCGGGAAGAGATGACCAAGAAC CAGGTGTCACTGTGGTGCCTGGTCAAGGGCTTC TACCCCTCTGATATCGCCGTGGAATGGGAGAGC AATGGCCAGCCTGAGAACAACTACAAGACCACA CCTCCTGTGCTGGACAGCGACGGCTCATTCTTC CTGTACAGCAAGCTGACAGTGGACAAGTCCAGA TGGCAGCAGGGCAACGTGTTCTCCTGCTCCGTG | SEQ ID NO: 1008 GAGGTGCAGCTGGTGGAATCTGGCGGAGGATTG GTTCAGCCTGGCGGCTCTCTGAGACTGTCTTGT GCCGCTTCTGGCTTCACCTTCAACACCTACGCT ATGAACTGGGTCCGACAGGCCCCTGGCAAAGGA CTGGAATGGGTCGGACGGATCCGGTCCAAGTAC AACAACTACGCCACCTACTACGCCGACTCCGTG AAGTCCAGATTCACCATCTCTCGGGACGACTCC AAGAACTCCCTGTACCTGCAGATGAACAGCCTG CGGACCGAGGATACCGCCGTGTACTATTGTGTG CGGCACGGCAACTTCGGCCACTCCTATGTGTCT TGGTTTGCCTACTGGGGCCAGGGCACACTGGTC ACAGTTTCTTCCGCCTCCACCAAGGGACCCAGC GTTTTCCCTCTGGCTCCATCCTCCAAGTCTACC TCTGGCGGAACAGCTGCTCTGGGCTGCCTGGTC AAGGACTACTTTCCTGAGCCTGTGACCGTGTCC TGGAACTCTGGCGCTCTGACATCTGGCGTGCAC ACCTTTCCAGCTGTGCTGCAGTCCTCCGGCCTG TACTCTCTGTCCTCTGTCGTGACCGTGCCTTCC AGCTCTCTGGGAACCCAGACCTACATCTGCAAT GTGAACCACAAGCCTTCCAACACCAAGGTGGAC AAGAAGGTGGAACCCAAGTCCTGCGACAAGACC CACACCTGTCCTCCATGTCCTGCTCCAGAAGCT GCTGGCCCTTCCGTGTTTCTGTTCCCTCCA AAGCCTAAGGACACCCTGATGATCTCTCGGACG CCTGAAGTGACCTGCGTGGTGGTGGATGTGTCT CACGAGGATCCCGAAGTGAAGTTCAATTGGTAC GTGGACGGCGTGGAAGTGCACAACGCCAAGACC AAGCCTAGAGAGGAACAGTACAACTCCACCTAC | SEQ ID NO: 1000 CAGGCCGTGGTCACCC AAGAGCCTAGCCTGAC AGTTTCTCCTGGCGGC ACCGTGACACTGACCT GTGGATCTTCTACCGG CGCTGTGACCACCGGC CACTACGCTAATTGGG TGCAGCAGAAGCCTGG ACAGGCTCCCAGAGGA CTGATCGGCGGCACCT CTAATAGAGCACCTGG CGTGCCAGCCAGATTC TCCGGATCTCTGCTTG GCGGAAAGGCCGCTCT GACAATCTCTGGTGCT CAGCCTGAGGACGAGG CCGAGTACTATTGTGC CCTGTGGTACTCCAAC AGATGGGTGTTCGGCG GAGGCACCAAGCTGAC AGTTCTGGGACAGCCT AAGGCTGCCCCTTCCG TGACTCTGTTCCCTCC ATCCTCTGAGGAACTG CAGGCCAACAAGGCTA CCCTCGTGTGCCTGAT CTCCGACTTTTACCCT GGCGCCGTGACCGTGG |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | ATGCACGAGGCCCTGCACAATCACTACACCCAG<br>AAGTCCCTGTCTCTGTCCCCTGGCAAA | AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCTCCATCGAA<br>AAGACCATCTCCAAGGCCAAGGGCCAGCCTAGG<br>GAACCCCAGGTTTACACCCTGCCACCTAGCCGG<br>GAAGAGATGACCAAGAACCAGGTGTCCCTGTCC<br>TGTGCCGTGAAGGCTTCTACCCTTCCGATATC<br>GCCGTGGAATGGGAGAGCAATGGCCAGCCTGAG<br>AACAACTACAAGACAACCCCTCCTGTGCTGGAC<br>TCCGACGGCTCATTCTTCCTGGTGTCCAAGCTG<br>ACAGTGGACAAGTCCAGGTGGCAGCAGGGCAAC<br>GTGTTCTCCTGCTCTGTGATGCACGAGGCCCTG<br>CACAACCGGTACACCCAGAAGTCTCTGTCTCTG<br>AGCCCTGGCAAG | CTTGGAAGGCTGATAG<br>TTCTCCTGTGAAGGCC<br>GGCGTGGAAACCACCA<br>CACCTAGCAAGCAGTC<br>CAACAACAAATACGCC<br>GCCTCCTCCTACCTGT<br>CTCTGACCCCTGAACA<br>GTGGAAGTCCCACCGG<br>TCCTACAGCTGCCAAG<br>TGACCCATGAGGGCTC<br>CACCGTGGAAAAGACA<br>GTGGCCCCTACCGAGT<br>GCTCT |
| 437<br>hCD4<br>D1.22<br>Fc<br>AAS + W +<br>YTE/<br>huSP3<br>4.41.13<br>AAS +<br>SAV + R | SEQ ID NO: 998<br>AAAAAGGTGGTGTACCGGCAAGAAGGGCGACACC<br>GTCGAGCTGACCTGTACCGCCTCTCAGAAGAAG<br>AACATCCAGTTCCACTGGAAGAACTCCAACCAG<br>ATCAAGATCCTGGGCAACCAGGGCAGCTTCCTG<br>ACCAAGGGACCTTCCAAGCTGAACGACAGAGTG<br>GACTCCAGACGGTCCCTGTGGGACCAGGGCAAC<br>TTTCCACTGATCATCAAGAACCTGAAGCCTGAG<br>GACTCCGACACCTACATCTGCGAGGTGGAAGAT<br>CAGAAGAAGAGGTGCAGCTGGTCGTCGTCGGC<br>GGCTCTGATAAGACCCATACCTGTCCTCCATGT<br>CCTGCTCCAGAAGCTGCTGGCGGCCCTTCCGTG<br>TTTCTGTTCCCTCCAAAGCTAAGGACACCCTG<br>TACATCACCCGCGAGCCTGAAGTGACCTGCGTG<br>GTGGTGGATGTGTCTCACGAGGACCCCGAAGTG<br>AAGTTCAATTGGTACGTGGACGGCGTGGAAGTG<br>CACAACGCCAAGACCAAGCCTAGAGAGGAACAG<br>TACAACTCCACCTACAGAGTGGTGTCCGTGCTG<br>ACCGTGCTGCACCAGGATTGGCTGAACGGCAAA<br>GAGTACAAGTGCAAGGTGTCCAACAAGGCCCTG<br>CCTGCCTCCATCGAAAAGACCATCTCCAAGGCC<br>AAGGGCCAGCCTAGGGAACCCCAGGTTTACACC<br>CTGCCACCTAGCCGGGAAGAGATGACCAAGAAC<br>CAGGTGTCACTGTGGTGCCTGGTCAAGGGCTTC<br>TACCCCTCTGATATCGCCGTGGAATGGGAGAGC<br>AATGGCCAGCCTGAGAACAACTACAAGACCACA<br>CCTCCTGTGCTGGACAGCGACGGCTCATTCTTC<br>CTGTACAGCAAGCTGACAGTGGACAAGTCCAGA<br>TGGCAGCAGGGCAACGTGTTCTCCTGCTCCGTG<br>ATGCACGAGGCCCTGCACAATCACTACACCCAG<br>AAGTCCCTGTCTCTGTCCCCTGGCAAA | SEQ ID NO: 1009<br>GAGGTGCAGCTGGTGGAATCTGGCGGAGGATTG<br>GTTCAGCCTGGCGGCTCTCTGTCTCTGTCTTGT<br>GCCGCTTCTGGCTTCACCTTCAACACCTACGCT<br>ATGAACTGGGTCCGACAGGCCCCTGGCAAAGGA<br>CTGGAATGGGTCGGACGGATCCGGTCCAAGTAC<br>AACAACTACGCCACCTACTACGCCGACTCCGTG<br>AAGGGCCGGTTCACCATCTCTCGGGACGACTCC<br>AAGAACACCCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGCCTCCACCAAGGGACCCAGC<br>GTTTTCCCTCTGGCTCCATCCTCCAAGTCTACC<br>TCTGGCGGAACAGCTGCTCTGGGCTGCCTGGTC<br>AAGGACTACTTTCCTGAGCCTGTGACCGTGTCC<br>TGGAACTCTGGCGCTCTGACATCTGGCGTGCAC<br>ACCTTTCCAGCTGTGCTGCAGTCCTCCGGCCTG<br>TACAGTCTGTCCTCTGTCGTGACCGTGCCTTCC<br>AGCTCTCTGGGAACCCAGACCTACATCTGCAAT<br>GTGAACCACAAGCCTTCCAACACCAAGGTGGAC<br>AAGAAGGTGGAACCCAAGTCCTGCGACAAGACC<br>CACACCTGTCCTCCATGTCCTGCTCCAGAAGCT<br>GCTGGCGGCCCTTCCGTGTTTCTGTTCCCTCCA<br>AAGCCTAAGGACACCCTGATGATCTCTCGGACC<br>CCTGAAGTGACCTGCGTGGTGGTGGATGTGTCT<br>CACGAGGATCCCGAAGTGAAGTTCAATTGGTAC<br>GTGGACGGCGTGGAAGTGCACAACGCCAAGACC<br>AAGCCTAGAGAGGAACAGTACAACTCCACCTAC<br>AGAGTGGTGTCCGTGCTGACCGTGCTGCACCAG<br>GATTGGCTGAACGGCAAAGAGTACAAGTGCAAG<br>GTGTCCAACAAGGCCCTGCCTGCCTCCATCGAA<br>AAGACCATCTCCAAGGCCAAGGGCCAGCCTAGG<br>GAACCCCAGGTTTACACCCTGCCACCTAGCCGG<br>GAAGAGATGACCAAGAACCAGGTGTCCCTGTCC<br>TGCGCCGTGAAGGGCTTCTACCCTTCTGATATC<br>GCCGTGGAATGGGAGAGCAACGGCCAGCCTGAG<br>AACAACTACAAGACAACCCCTCCTGTGCTGGAC<br>TCCGACGGCTCATTCTTCCTGGTGTCCAAGCTG<br>ACAGTGGACAAGTCTAGATGGCAGCAGGGCAAC<br>GTGTTCTCCTGCTCCGTGATGCACGAGGCCCTG<br>CACAACAGATACACCCAGAAGTCCCTGTCTCTG<br>AGCCCCGGAAAA | SEQ ID NO: 1000<br>CAGGCCGTGGTCACCC<br>AAGAGCCTAGCCTGAC<br>AGTTTCTCCTGGCGGC<br>ACCGTGACACTGACCT<br>GTGGATCTTCTACCGG<br>CGCTGTGACCACCGGC<br>CACTACGCTAATTGGG<br>TGCAGCAGAAGCCTGG<br>ACAGGCTCCCAGAGGA<br>CTGATCGGCGGCACCT<br>CTAATAGAGCACCTGG<br>CGTGCCAGCCAGATTC<br>TCCGGATCTCTGCTTG<br>GCGGAAAGGCCGCTCT<br>GACAATCTCTGGTGCT<br>CAGCCTGAGGACGAGG<br>CCTGAGTACTATTGTGC<br>CCTGTGGTACTCCAAC<br>AGATGGGTGTTCGGCG<br>GAGGCACCAAGCTGAC<br>AGTTCTGGGACAGCCT<br>AAGGCTGCCCCTTCCG<br>TGACTCTGTTCCCTCC<br>ATCCTCTGAGGAACTG<br>CAGGCCAACAAGGCTA<br>CCCTCGTGTGCCTGAT<br>CTCCGACTTTTACCCT<br>GGCGCCGTGACCGTGG<br>GGTGGAAGTCCCACCGG<br>TCCTACAGCTGCCAAG<br>TGACCCATGAGGGCTC<br>CACCGTGGAAAAGACA<br>GTGGCCCCTACCGAGT<br>GCTCT |
| 438<br>h3BNC<br>117.52.<br>64<br>AAS +<br>SAV +<br>YTE/hu<br>SP34.3.13<br>scFv<br>AAS + W +<br>YTE | SEQ ID NO: 1010<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTGGGACGGATCAGAAGCAAGTAC<br>AACAATTACGCCACCTACTACGCCGACTCCGTG<br>AAGGGCAGATTCACCATCTCTCGGGACGACTCC<br>AAGAACACCCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGTGGAAGCGGAGGC<br>GGAGGTAGTGGCGGTGGTGGTTCAGGTGGTGGT<br>GGATCTCAGGCTGTGGTTACCCAGGAGCCTAGC | SEQ ID NO: 1011<br>CAGGTGCAGCTGCAGTCTGGCGCCGCTGTG<br>ACAAAACCAGGCGCTTCTGTGCGGGTGTCCTGC<br>GAGGCCAGCGGCTACAACATCCGGGACTACTTC<br>ATTCACTGGGTGCGCCAGGCCCCTGGACAGGGA<br>CTGCAGTGGATGGGATGGATCAACCCCAAGACC<br>GGCCAGCCCAACAACCCCAGACAGTTCCAGGGC<br>AGAGTGCCCTGACCAGACACGCCAGCTTCGAC<br>TTCGACACCTTCAGCTTCTACATGGACCTGAAG<br>GCCCTGCAGAGCGACGATACCGCCGTCTATTTC<br>TGCGCCAGACAGAAGCGACTACTGGGATTTC<br>GACGTGTGGGGCAGCGGCACCCAAGTGACCGTG<br>TCATCTGCCTCTACAAAGGGCCCTAGTGTGTTC<br>CCTCTGGCTCCCAGCAGCAAGTCTACATCTGGC<br>GGAACAGCCGCTCTGGGCTGCCTGGTCAAGGAT | SEQ ID NO: 1012<br>GATATTCAGATGACAC<br>AGAGCCCCAGTAGCCT<br>GAGCGCCAGCGTGGGC<br>GACACCGCAACCATCA<br>CCTGTCAGGCCAACGG<br>CTATCTGAACTGGTAT<br>CAACAGAGGAGGGCA<br>AGGCCCCAAGCTCCT<br>GATATACGACGCAGC<br>AAGCTGGAGAGGGCG<br>TTCCCAGCCGCTTCAG<br>CGGCAGGAGTGGGGC<br>CAGGAGTACAACCTTA<br>CAATCAACAACCTGCA |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | CTGACAGTTTCTCCTGGCGGCACCGTGACACTG<br>ACCTGTGGATCTTCTACCGGCGCTGTGACCACC<br>GGGCCATTACGCTAATTGGGTGCAGCAGAAGCCT<br>GGACAGGCCCCAAGAGGACTGATCGGCGGCACA<br>TCTAACAGAGCCCCTGGCGTCCCAGCCAGATTC<br>TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCTGTGTTCCTGTTTCCTCCAAAGCCT<br>AAGGACACCCTGTACATCACCCGCGAGCCTGAA<br>GTGACCTGTGTGGTGGTGGATGTGTCCCACGAG<br>GACCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGTGGTGCCTC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGTACAGCAAGCTGACAGTG<br>GACAAGTCCAGATGGCAGCAGGGCAACGTGTTC<br>AGCTGCAGCGTGATGCACGAGGCCCTGCACAAC<br>CACTACACCCAGAAGTCCCTGAGCCTGTCTCCT<br>GGCAAA | TACTTTCCGAGCCTGTGACCGTGTCCTGGAAT<br>TCTGCTGCTCTGACAAGCGGCGTGCACACCTTT<br>CCAGCTGTGCTGCAAAGCAGCGGCCTGTACTCT<br>CTGAGCAGCGTGGTCACAGTGCCTAGCTCTAGC<br>CTGGGCACCCAGACCTACATCTGCAATGTGAAC<br>CACAAGCCTAGCAACACCAAGGTGGACAAGAAG<br>GTGGAACCCAAGAGCTGCGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGTACATCACCCGCGAGCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGAGCTGTGCC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGGTGTCCAAGCTGACAGTG<br>GACAAGTCCAGATGGCAGCAGGGCAACGTGTTC<br>AGCTGCAGCGTGATGCACGAGGCCCTGCACAAC<br>CACTACACCCAGAAGTCCCTGTCTCTGAGCCCC<br>GGCAAA | GCCCGAGGACATCGCC<br>ACCTATTTCTGCCAAG<br>TTTACGAGTTCGTGGT<br>GCCCGGCACCAGGCTG<br>GACCTGAAGCGGACCG<br>TGGCCGCCCCCAGCGT<br>GTTCATCTTCCCTCCC<br>AGCGACGAGCAGCTGA<br>AGTCTGGCACCGCCAG<br>CGTGGTGTGCCTGCTG<br>AACAACTTCTACCCCC<br>GCGAGGCCAAGGTGCA<br>GTGGAAGGTGGACAAC<br>GCCCTGCAGAGCGGCA<br>ACAGCCAGGAGAGCGT<br>GACCGAGCAGGACTCC<br>AAGGACAGCACCTACA<br>GCCTGAGCAGCACCCT<br>GACCCTGAGCAAGGCC<br>GACTACGAGAAGCACA<br>AGGTGTACGCCTGCGA<br>GGTGACCCACCAGGGA<br>CTGTCTAGCCCCGTGA<br>CCAAGAGCTTCAACCG<br>GGGCGAGTGC |
| 439 h3BNC 117.52.64 AAS + SAV + YTE/huS P34.3.13 scFv AAS + W + YTE | SEQ ID NO: 1013<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCT<br>ATGAACTGGGTCCGACAGGCCCCTGGCAAAGGA<br>CTGGAATGGGTCGGACGGATCCGGTCCAAGTAC<br>AACAACTACGCCACCTACTACGCCGACTCCGTG<br>AAGGGCAGATTCACCATCTCTCGGGACGACTCC<br>AAGAATCCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTAGCGGCGGAGGTGAAGCGGAGGC<br>GGAGGTAGTGGTGGTGGCGGATCTGGTGGCGGT<br>GGATCTCAGGCTGTGGTCACCCAAGAGCCTAGC<br>CTGACAGTTTCTCCTGGCGGCACCGTGACACTG<br>ACCTGTGGATCTTCTACCGGCGCTGTGACCACC<br>GGCCACTACGCTAATTGGGTGCAGCAGAAGCCT<br>GGACAGGCTCCCAGAGGACTGATCGGCGGCACC<br>TCTAATAGAGCACCTGGCGTGCCAGCCAGATTC<br>TCTGGATCTCTGCTCGGCGGAAAGGCCGCTCTG<br>ACAATTTCTGGTGCCCAGCCTGAGGACGAGGCC<br>GAGTATTATTGTGCCCTGTGGTACTCCAACCGC<br>TGGGTTTTCGGCGGAGGCACCAAGCTGACAGTG<br>CTGGAACCTAAGTCCTCCGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGTACATCACCCGCGAGCCTGAA<br>GTGACCTGCGTGGTGCGATGTGTCTCACGAG<br>GACCCCGAAGTGAAGTTCAATTGGTACGTGGAC<br>GGCGTGGAAGTGCACAACGCCAAGACCAAGCCT<br>AGAGAGGAACAGTACAACTCCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCTCCATCGAAAAGACC<br>ATCTCCAAGGCCAAGGGCCAGCCTAGGGAACCC<br>CAGGTTTACACCCTGCCTCCAGGGAAGAG<br>ATGACCAAGAACCAGGTGTCCCTGTGGTGCCTG<br>GTCAAGGGCTTCTACCCTTCCGATATCGCCGTG<br>GAATGGGAGAGCAACGGACAGCCCGAGAACAAC | SEQ ID NO: 1014<br>CAGGTGCAGCTGTTGCAATCTGGCGCCGCTGTG<br>ACAAAGCCTGGTGCCTCTGTTAGAGTGTCCTGC<br>GAGGCCTCCGGCTACAACATCCGGGACTACTTC<br>ATCCACTGGTGGCGGCAGGCTCCAGGACAGGGA<br>TTGCAATGGGTCGGATGGATCAACCCCAAGACC<br>GGCCAGCCTAACAACCCTAGACAGTTCCAGGGC<br>AGAGTGTCCTTGACCCGGACACGCCTCTTTCGAC<br>TTCACACCTTCAGCTTCTACATGGACCTGAAG<br>GCCCTGCGGAGCGACGATACCGCCGTGTACTTT<br>TGCGCCAGACAGAGATCCGACTACTGGGACTTC<br>GACGTGTGGGGCTCTGGCACCCAAGTGACAGTG<br>TCCTCCGCTTCCACCAAGGGACCCCTCTGTTT<br>CCTCTGGCTCCCTCCAGCAAGTCTACCTCTGGT<br>GGAACAGCTGCTCTGGGCTGCCTGGTCAAGGAT<br>TACTTCCCTGAGCCTGTGACCGTGTCCTGGAAT<br>TCTGGCGCTCTGACATCCGGCGTGCACACCTTT<br>CCAGCTGTGCTGCAATCCTCCGGCCTGTACTCT<br>CTGTCCTCCGTCGTGACCGTGCCTTCTAGCTCT<br>CTGGGCACCCAGACCTACATCTGCAATGTGAAC<br>CACAAGCCTTCCAACACCAAGGTGGACAAGAAG<br>GTGGAACCCAAGTCCTGCGACAAGACCCACACC<br>TGTCCTCCATGTCCTGCTCCAGAAGCTGCTGGC<br>GGCCCATTCCGTTTCTGTTCCCTCCAAAGCCT<br>AAGGACACCCTGTACATCACCCGCGAGCCTGAA<br>GTGACCTGCGTGGTGGTGGATGTGTCTCACGAG<br>GACCCCGAAGTGAAGTTCAATTGGTACGTGGAC<br>GGCGTGGAAGTGCACAACGCCAAGACCAAGCCT<br>AGAGAGGAACAGTACAACTCCACCTACAGAGTG<br>GTGTCCGTGCTGACCGTGCTGCACCAGGATTGG<br>CTGAACGGCAAAGAGTACAAGTGCAAGGTGTCC<br>AACAAGGCTCTGCCCGCCTCCATCGAAAAGACC<br>ATCTCCAAGGCTAAGGGCCAGCCTCGGGAACCC<br>CAGGTTTACACCATTCCTCCAAGCCGGGAAGAG<br>ATGACCAAGAACCAGGTGTCCCTGAGCTGCGCC<br>GTGAAGGGCTTCTACCCTTCTGATATCGCCGTG<br>GAATGGGAGTCCAACGGCCAGCCAGAGAACAAC<br>TACAAGACAACCCCTCCTGTGCTGGACTCCGAC<br>GGCTCATTCTTCCTGGTGTCTAAGCTGACAGTG<br>GACAAGTCCAGATGGCAGCAGGGCAACGTGTTC | SEQ ID NO: 1015<br>GACATCCAGATGACCC<br>AGTCTCCATCCTCTCT<br>GTCCGCCTCTGTGGGA<br>GATAGGGTTACCATTA<br>CCTGTCAGGCCAACGG<br>CTACCTGAACTGGTAT<br>CAGCAGCGGAAGGCA<br>AGGCCCCTAAGCTGCT<br>GATCTACGACGGCTCC<br>AAGCTGGAAAGAGGCG<br>TGCCCTCCAGATTCTC<br>CGGCAGAAGATGGGGC<br>CAAGAGTACAACCTGA<br>CCATCAACAACCTGCA<br>GCCTGAGGATATCGCC<br>ACATACTTTTGCCAGG<br>TGTACGAGTTCGTGGT<br>GCCCGGCACAAGACTG<br>GACCTGAAGAGAACAG<br>TGGCCGCTCCTTCCGT<br>GTTCATCTTCCCACCT<br>TCCGACGAGCAGCTGA<br>AGTCTGGCACAGCCTC<br>TGTCGTGTGCCTGCTG<br>AACAACTTCTACCCTC<br>GGGAAGCCAAGGTGCA<br>GTGGAAGGTGGACAAT<br>GCCCTGCAGTCCGGCA<br>ACTCCCAAGAGTCTGT<br>GACCGAGCAGGACTCC<br>AAGGACAGCACCTACA<br>GCCTGTCCTCCACACT<br>GACCCTGTCCAAGGCC<br>GACTACGAGAAGCACA<br>AGGTGTACGCCTGCGA<br>AGTGACCCATCAGGGC<br>CTGTCTAGCCCCGTGA<br>CCAAGTCTTTCAACCG<br>GGGCGAGTGT |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | TACAAGACAACCCCTCCTGTGCTGGACTCCGAC<br>GGCTCATTCTTCCTGTACAGCAAGCTGACTGTG<br>GACAAGTCCAGATGGCAGCAGGGCAACGTGTTC<br>TCCTGCTCCGTGATGCACGAGGCCCTGCACAAT<br>CACTACACCCAGAAGTCCCTGTCTCTGAGCCCT<br>GGCAAG | TCCTGCTCCGTGATGCACGAGGCCCTGCACAAT<br>CACTACACCCAGAAGTCCCTGTCTCTGTCCCCT<br>GGCAAA | |
| 440 h3BNC 117.52.64 AAS + SAV/hu SP34.3.13 scFv AAS + W | SEQ ID NO: 1016<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGGGCAGATTCACCATCTCTCGGGACGACTCC<br>AAGAACTCCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGTGGAAGCGGAGGC<br>GGAGGTAGTGGCGGTGGTGGTTCAGGTGGTGGT<br>GGATCTCAGGCTGTGGTTACCCAGGAGCCTAGC<br>CTGACAGTTTCTCCTGGCGGCACCGTGACAGTG<br>ACCTGTGGATCTTCTACCGGCGCTGTGACCACC<br>GGCCATTACGCTAATTGGGTGCAGCAGAAGCCT<br>GGACAGGCCCCAAGAGGACTGATCGGCGGCACA<br>TCTAACAGAGCCCCTGGCGTCCCAGCCAGATTC<br>TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGATGATCAGCAGAACCCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACCCTGCCTCCAAGCCGGGAAGAG<br>ATGACCAAGAACCAGGTGTCCCTGTGGTGCCTG<br>GTCAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGTACAGCAAGCTGACAGTG<br>GACAAGAGCAGATGGCAGCAGGGCAACGTGTTC<br>AGCTGCAGCGTGATGCACGAGGCCCTGCACAAC<br>CACTACACCCAGAAGTCCCTGAGCCTGTCTCCT<br>GGCAAA | SEQ ID NO: 1017<br>CAGGTGCAGCTGCTGCAGTCTGGCGCCGCTGTG<br>ACAAAACCAGGCGCTTCTGTGCGGGTGTCCTGC<br>GAGGCCAGCGGCTACAACATCCGGGACTACTTC<br>ATTCACTGGTGGCGCCAGGCCCCTGGACAGGGA<br>CTGCAGTGGGTGGGATGGATCAACCCCAAGACC<br>GGCCAGCCCAACAACCCCAGACAGTTCCAGGGC<br>AGAGTGTCCGACCAGACACGCCAGCTTCGAC<br>TTCGACACCTTCAGCTTCTACATGGACCTGAAG<br>GCCCTGCGGAGCGACGATACCGCCGTGTACTTC<br>TGCGCCAGACAGAGAAGCGACTACTGGGATTTC<br>GACGTGTGGGGCAGCGGCACCCAAGTGACCGTG<br>TCATCTGCCTCTACAAAGGGCCCTAGTGTGTTC<br>CCTCTGGCTCCCAGCAGCAAGTCTACATCTGGC<br>GGAACAGCCGCTCTGGGCTGCCTGGTCAAGGAT<br>TACTTTCCCGAGCCTGTGACCGTGTCCTGGAAT<br>TCTGGCGCTCTGACAAGCGGCGTGCACACCTTT<br>CCAGCTGTGCTGCAAAGCAGCGGCCTGTACTCT<br>CTGAGCAGCGTGGTCACAGTGCCTAGCTCTAGC<br>CTGGGCACCCAGACCTACATCTGCAATGTGAAC<br>CACAAGCCTAGCAACACCAAGGTGGACAAGAAG<br>GTGGAACCCAAGAGCTGCGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGATGATCAGCAGAACCCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGAGCTGTGCC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGGTGTCCAAGCTGACAGTG<br>GACAAGTCCAGATGGCAGCAGGGCAACGTGTTC<br>AGCTGCAGCGTGATGCACGAGGCCCTGCACAAC<br>CACTACACCCAGAAGTCCCTGTCTCTGAGCCCC<br>GGCAAA | SEQ ID NO: 1012<br>GATATTCAGATGACAC<br>AGAGCCCCAGTAGCCT<br>GAGCGCCAGCGTGGGC<br>GACACCGCAACCATCA<br>CCTGTCAGGCCAACGG<br>CTATCTGAACTGGTAT<br>CAACAGAGGAGGGCA<br>AGGCCCCAAGCTCCT<br>GATATACGACGGCAGC<br>AAGCTGGAGAGGGGCG<br>TTCCCAGCCGCTTCAG<br>CGGCAGGAGGTGGGC<br>CAGGAGTACAACCTTA<br>CAATCAACAACCTGCA<br>GCCCGAGGACATCGCC<br>ACCTATTTCTGCCAAG<br>TTTACGAGTTCGTGGT<br>GCCCGGCACCAGGCTG<br>GACCTGAAGCGGACCG<br>TGGCCGCCCCAGCGT<br>GTTCATCTTCCCTCCC<br>AGCGACGAGCAGCTGA<br>AGTCTGGCACCGCCAG<br>CGTGGTGTGCCTGCTG<br>AACAACTTCTACCCCC<br>GCGAGGCCAAGGTGCA<br>GTGGAAGGTGGACAAC<br>GCCCTGCAGAGCGGCA<br>ACAGCCAGGAGAGCGT<br>GACCGAGCAGGACTCC<br>AAGGACAGCACCTACA<br>GCCTGAGCAGCACCCT<br>GACCCTGAGCAAGGCC<br>GACTACGAGAAGCACA<br>AGGTGTACGCCTGCGA<br>GGTGACCCACCAGGGA<br>CTGTCTAGCCCCGTGA<br>CCAAGAGCTTCAACCG<br>GGGCGAGTGC |
| 441 h3BNC 117.52.64 AAS + W + YTE/ huSP34. 39.13 scFv AAS + SAV + R | SEQ ID NO: 1018<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGAGCAGATTCACCATCTCTCGGGACGACTCC<br>AAGAACTCCCTGTACCTGGAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGTGGAAGCGGAGGC<br>GGAGGTAGTGGCGGTGGTGGTTCAGGTGGTGGT<br>GGATCTCAGGCTGTGGTTACCCAGGAGCCTAGC<br>CTGACAGTTTCTCCTGGCCACCGTGACACTG<br>ACCTGTGGATCTTCTACCGGCGCTGTGACCACC<br>GGCCATTACGCTAATTGGGTGCAGCAGAAGCCT<br>GGACAGGCCCCAAGAGGACTGATCGGCGGCACA<br>TCTAACAGAGCCCCTGGCGTCCCAGCCAGATTC | SEQ ID NO: 1019<br>CAGGTGCAGCTGCTGCAGTCTGGCGCCGCTGTG<br>ACAAAACCAGGCGCTTCTGTGCGGGTGTCCTGC<br>GAGGCCAGCGGCTACAACATCCGGGACTACTTC<br>ATTCACTGGTGGCGCCAGGCCCCTGGACAGGGA<br>CTGCAGTGGGTGGGATGGATCAACCCCAAGACC<br>GGCCAGCCCAACAACCCCAGACAGTTCCAGGGC<br>AGAGTGTCCGACCAGACACGCCAGCTTCGAC<br>TTCGACACCTTCAGCTTCTACATGGACCTGAAG<br>GCCCTGCGGAGCGACGATACCGCCGTGTACTTC<br>TGCGCCAGACAGAGAAGCGACTACTGGGATTTC<br>GACGTGTGGGGCAGCGGCACCCAAGTGACCGTG<br>TCATCTGCTAGCACCAAGGGCCCTCCGTGTTT<br>CCACTGGCTCCTAGCAGCAAGAGCACAAGCGGA<br>GGAACAGCCGCTCTGGGCTGTCTGGTCAAGGAC<br>TACTTTCCCGAGCCTGTGACCGTGTCCTGGAAT<br>TCTGGCGCTCTGACAAGCGGCGTGCACACCTTT<br>CCAGCTGTGCTGCAAAGCAGCGGCCTGTACTCT<br>CTGAGCAGCGTGGTCACAGTGCCAAGCTCTAGC<br>CTGGGCACCCAGACCTACATCTGCAATGTGAAC | SEQ ID NO: 1012<br>GATATTCAGATGACAC<br>AGAGCCCCAGTAGCCT<br>GAGCGCCAGCGTGGGC<br>GACACCGCAACCATCA<br>CCTGTCAGGCCAACGG<br>CTATCTGAACTGGTAT<br>CAACAGAGGAGGGCA<br>AGGCCCCAAGCTCCT<br>GATATACGACGGCAGC<br>AAGCTGGAGAGGGGCG<br>TTCCCAGCCGCTTCAG<br>CGGCAGGAGGTGGGC<br>CAGGAGTACAACCTTA<br>CAATCAACAACCTGCA<br>GCCCGAGGACATCGCC<br>ACCTATTTCTGCCAAG<br>TTTACGAGTTCGTGGT<br>GCCCGGCACCAGGCTG<br>GACCTGAAGCGGACCG |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGATGATCAGCAGAACCCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGAGCTGTGCC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGGTGTCCAAGCTGACAGTG<br>GACAAGTCCAGATGGCAGCAGGGCAACGTGTTC<br>AGCTGCAGCGTGATGCACGAGGCCCTGCACAAC<br>CGGTACACCCAGAAGTCCCTGTCTCTGAGCCCC<br>GGCAAA | CACAAGCCTAGCAACACCAAGGTGGACAAGAAG<br>GTGGAACCCAAGAGCTGCGACAAGACCCACACC<br>TGTCCTCCATGTCCTGCTCCAGAAGCTGCTGGC<br>GGCCCTTCCGTGTTCCTGTTTCCTCCAAAGCCT<br>AAGGACACCCTGTACATCACCCGCGAGCCTGAA<br>GTGACCTGTGTGGTGGTGGATGTGTCCCACGAG<br>GACCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGTGGTCCCTC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGTACAGCAAGCTGACAGTG<br>GACAAGTCCAGATGGCAGCAGGGCAACGTGTTC<br>AGCTGCAGCGTGATGCACGAGGCCCTGCACAAC<br>CACTACACCCAGAAGTCCCTGAGCCTGTCTCCT<br>GGCAAA | TGGCCGCCCCCAGCGT<br>GTTCATCTTCCCTCCC<br>AGCGACGAGCAGCTGA<br>AGTCTGGCACCGCCAG<br>CGTGGTGTGCCTGCTG<br>AACAACTTCTACCCCC<br>GCGAGGCCAAGGTGCA<br>GTGGAAGGTGGACAAC<br>GCCCTGCAGAGCGGCA<br>ACAGCCAGGAGAGCGT<br>GACCGAGCAGGACTCC<br>AAGGACAGCACCTACA<br>GCCTGAGCAGCACCCT<br>GACCCTGAGCAAGGCC<br>GACTACGAGAAGCACA<br>AGGTGTACGCCTGCGA<br>GGTGACCCACCAGGGA<br>CTGTCTAGCCCCGTGA<br>CCAAGAGCTTCAACCG<br>GGGCGAGTGC |
| 442<br>h3BNC<br>117.52.64<br>AAS +<br>W/huSP34.<br>39.13<br>scFv<br>AAS +<br>SAV + R | SEQ ID NO: 1018<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGAGCAGATTCACCATCTCTCGGGACGACTCC<br>AAGAACACCCTGTACCTGGAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGCGGTGAAGCGGAGGC<br>GGAGGTAGTGGCGGTGGTGGTTCAGGTGGTGGT<br>GGATCTCAGGCTGTGGTTACCCAGGAGCCTAGC<br>CTGACAGTTTCTCCTGGCGGCACCGTGACACTG<br>ACCTGTGGATCTTCTACCGGCGCTGTGACCACC<br>GGCCATTACGCTAATTGGGTACAGCAGAAGCCT<br>GGACAGGCCCAAGAGGACTGATCGGCGGCACA<br>TCTAACGAGCCCCTGGCGTCCCAGCCAGATTC<br>TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGATGATCAGCAGAACCCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGAGCTGTGCC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGGTGTCCAAGCTGACAGTG<br>GACAAGTCCAGATGGCAGCAGGGCAACGTGTTC<br>AGCTGCAGCGTGATGCACGAGGCCCTGCACAAC<br>CGGTACACCCAGAAGTCCCTGTCTCTGAGCCCC<br>GGCAAA | SEQ ID NO: 1020<br>CAGGTGCAGCTGCTGCAGTCTGGCGCCGCTGTG<br>ACAAAACCAGGCGCTTCTGTGCGGGTGTCCTGC<br>GAGGCCAGCGGCTACAACATCCGGGACTACTTC<br>ATTCACTGGTGGCGCCAGGCCCCTGGACAGGGA<br>CTGGAATGGATGGGATGGATCAACCCCAAGACC<br>GGCCAGCCCAACAACCCCAGACAGTTCCAGGGC<br>AGAGTGTCCCTGACCAGACACGCCAGCTTCGAC<br>TTCTCCACCTTCTCTACTACATGGACCTGAAG<br>GCCCTGCGGAGCGACGATACCGCCGTGTACTTC<br>TGCGCCAGACAGAGAAGCGACTACTGGGATTTC<br>GACGTGTGGGGCAGCGGCACCCAAGTGACCGTG<br>TCATCTGCTAGCACCAAGGGCCCCTCCGTGTTT<br>CCACTGGCTCCTAGCAGCAAGAGCACAAGCGGA<br>GGAACAGCCGCTCTGGGCTGTCTGGTCAAGGAC<br>TACTTTCCCGAGCCTGTGACCGTGTCCTGGAAT<br>TCTGGCGCCCTGACAAGCGGCGTGCACACCTTT<br>CCAGCTGTGCTGCAAAGCAGCGGCCTGTACTCT<br>CTGAGCAGCGTGGTCACAGTGCCAAGCTCTAGC<br>CTGGGCACCCAGACCTACATCTGCAATGTGAAC<br>CACAAGCCTAGCAACACCAAGGTGGACAAGAAG<br>GTGGAACCCAAGAGCTGCGACAAGACCCACACC<br>TGTCCTCCATGTCCTGCTCCAGAAGCTGCTGGC<br>GGCCCTTCCGTGTTCCTGTTTCCTCCAAAGCCT<br>AAGGACACCCTGTACATCACCCGCGAGCCTGAA<br>GTGACCTGTGTGGTGGTGGATGTGTCCCACGAG<br>GACCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGTGGTGCCTC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGTACAGCAAGCTGACAGTG<br>GACAAGTCCAGATGGCAGCAGGGCAACGTGTTC<br>AGCTGCAGCGTGATGCACGAGGCCCTGCACAAC<br>CACTACACCCAGAAGTCCCTGAGCCTGTCTCCT<br>GGCAAA | SEQ ID NO: 1012<br>GATATTCAGATGACAC<br>AGAGCCCCAGTAGCCT<br>GAGCGCCAGCGTGGGC<br>GACACCGCAACCATCA<br>CCTGTCAGGCCAACGG<br>CTATCTGAACTGGTAT<br>CAACAGAGGAGGGGCA<br>AGGCCCCCAAGCTCCT<br>GATATACGACGGCAGC<br>AAGCTGGAGAGGGGCG<br>TTCCCAGCCGCTTCAG<br>CGGCAGGAGGTGGGGC<br>CAGGAGTACAACCTTA<br>CAATCAACAACCTGCA<br>GCCCGAGGACATCGCC<br>ACCTATTTCTGCCAAG<br>TTTACGAGTTCGTGGT<br>GCCCGGCACCAGGCTG<br>GACCTGAAGCGGACCG<br>TGGCCGCCCCCAGCGT<br>GTTCATCTTCCCTCCC<br>AGCGACGAGCAGCTGA<br>AGTCTGGCACCGCCAG<br>CGTGGTGTGCCTGCTG<br>AACAACTTCTACCCCC<br>GCGAGGCCAAGGTGCA<br>GTGGAAGGTGGACAAC<br>GCCCTGCAGAGCGGCA<br>ACAGCCAGGAGAGCGT<br>GACCGAGCAGGACTCC<br>AAGGACAGCACCTACA<br>GCCTGAGCAGCACCCT<br>GACCCTGAGCAAGGCC<br>GACTACGAGAAGCACA<br>AGGTGTACGCCTGCGA<br>GGTGACCCACCAGGGA<br>CTGTCTAGCCCCGTGA<br>CCAAGAGCTTCAACCG<br>GGGCGAGTGC |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| 443 hPGT1 21.66 AAS + W/huSP 34.3.13 scFv AAS + SAV + R | SEQ ID NO: 1021<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGGGCAGATTCACCATCTCTCGGGACGACTCC<br>AAGAACTCCCTGTACCTGCAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGTGGAAGCGGAGGC<br>GGAGGTAGTGGCGGTGGTGGTTCAGGTGGTGGT<br>GGATCTCAGGCTGTGGTTACCCAGGAGCCTAGC<br>CTGACAGTTTCTCCTGGCGGCACCGTGACACTG<br>ACCTGTGGATCTTCTACCGGCGCTGTGACCACC<br>GGCCATTACGCTAATTGGGTGCAGCAGAAGCCT<br>GGACAGGCCCCAAGAGGACTGATCGGCGGCACA<br>TCTAACAGAGCCCCTGGCGTCCCAGCCAGATTC<br>TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCCGTGTTTCTGTTCCCTCCAAAGCCT<br>AAGGACACCCTGATGATCAGCAGAACCCCTGAA<br>GTGACCTGCGTGGTGGTGGATGTGTCCCACGAG<br>GATCCCGAAGTGAAGTTCAATTGGTACGTGGAC<br>GGCGTGGAAGTGCACAACGCCAAGACCAAGCCT<br>AGAGAGGAACAGTACAACAGCACCTACAGAGTG<br>GTGTCCGTGCTGACCGTGCTGCACCAGGATTGG<br>CTGAACGGCAAAGAGTACAAGTGCAAGGTGTCC<br>AACAAGGCCCTGCCTGCCAGCATCGAGAAAACC<br>ATCAGCAAGGCCAAGGGCCAGCCTAGGGAACCC<br>CAGGTTTACACACTGCCTCCAAGCCGGGAAGAG<br>ATGACCAAGAACCAGGTGTCCCTGAGCTGTGCC<br>GTGAAGGGCTTCTACCCTTCCGATATCGCCGTG<br>GAATGGGAGAGCAATGGCCAGCCTGAGAACAAC<br>TACAAGACAACCCCTCCTGTGCTGGACAGCGAC<br>GGCTCATTCTTCCTGGTGTCCAAGCTGACAGTG<br>GACAAGTCCAGATGGCAGCAGGGCAACGTGTTC<br>AGCTGCAGCGTGATGCACGAGGCCCTGCACAAC<br>CGGTACACCCAGAAGTCCCTGTCTCTGAGCCCC<br>GGCAAA | SEQ ID NO: 1022<br>CAGATGCAGCTGCAGGAATCTGGCCCTGGCCTC<br>GTGAAGCCCTCCGAGACACTGTCCCTGACCTGC<br>TCTGTGTCCGGCGCCTCCATCTCCGACTCCTAC<br>TGGTCTTGGATCCGGCGATCCCCTGGCAAGGGC<br>CTGGAATGGATCGGCTACGTGCACAAGTCCGGC<br>GACACCAACTACAATCCCAGCCTGAAGTCCAGA<br>GTGCACCTGTCCCTGGACACCTCCAAGAACCAG<br>GTGTCCCTGTCTCTGACTGGTGTCACCGCTGCT<br>GACTCCGGCAAGTACTACTGCGCCAGAACCCTG<br>CACGGCCAGACGGATCTACGGCATCGTGGCCTTC<br>AACGAGTGGTTCACCTACTTCTACATGGACGTG<br>TGGGGCACCGGCACCCAAGTGACCGTGTCCTCT<br>GCCTCTACAAAGGGCCCTAGTGTGTTCCCTCTG<br>GCTCCCAGCAGCAAGTCTACATCTGGCGGAACA<br>GCCGCTCTGGGCTGCCTGGTCAAGGATTACTTT<br>CCCGAGCCTGTGACCGTGTCCTGGAATTCTGGC<br>GCTCTGACAAGCGGCGTGCACACCTTTCCAGCT<br>GTGCTGCAAAGCAGCGGCCTGTACTCTCTGAGC<br>AGCGTGGTCACAGTGCCTAGCTCTAGCCTGGGC<br>ACCCAGACCTACATCTGCAATGTGAACCACAAG<br>CCTAGCAACACCAAGGTGGACAAGAAGGTGGAA<br>CCCAAGAGCTGCGACAAGACCCACACCTGTCCT<br>CCATGTCCTGCTCCAGAAGCTGCTGGCGGCCCT<br>TCCGTGTTTCTGTTCCCTCCAAAGCCTAAGGAC<br>ACCCTGATGATCAGCAGAACCCCTGAAGTGACC<br>TGCGTGGTGGTGGATGTGTCCCACGAGGATCCC<br>GAAGTGAAGTTCAATTGGTACGTGGACGGCGTG<br>GAAGTGCACAACGCCAAGACCAAGCCTAGAGAG<br>GAACAGTACAACAGCACCTACAGAGTGGTGTCC<br>GTGCTGACCGTGCTGCACCAGGATTGGCTGAAC<br>GGCAAAGAGTACAAGTGCAAGGTGTCCAACAAG<br>GCCCTGCCTGCCAGCATCGAGAAAACCATCAGC<br>AAGGCCAAGGGCCAGCCTAGGGAACCCCAGGTT<br>TACACACTGCCTCCAAGCCGGGAAGAGATGACC<br>AAGAACCAGGTGTCCCTGTGGTGTCTGGTGAAA<br>GGCTTCTACCCTTCCGATATCGCCGTGGAATGG<br>GAGAGCAATGGCCAGCCTGAGAACAACTACAAG<br>ACAACCCCTCCTGTGCTGGACAGCGACGGCTCA<br>TTCTTCCTGTACTCCAAGCTGACAGTGGACAAG<br>TCCAGATGGCAGCAGGGCAACGTGTTCAGCTGC<br>AGCGTGATGCACGAGGCCCTGCACAACCACTAC<br>ACCCAGAAGTCCCTGTCTCTGAGCCCCGGCAAA | SEQ ID NO: 1023<br>AGCGACATCAGCGTGG<br>CCCCAGGCGAGACCGC<br>CAGGATCAGCTGCGGC<br>GAGAAGAGCCTGGGCA<br>GCAGGGCCGTGCAATG<br>GTATCAGCACAGGGCA<br>GGCCAGGCCCCCAGCC<br>TGATCATCTACAACAA<br>CCAGGACAGGCCCAGC<br>GGCATCCCCGAGAGGT<br>TCAGTGGCAGCCCCGA<br>CTTCAGGCCCGGTACC<br>ACAGCCACCCTGACCA<br>TCACCTCAGTGGAGGC<br>CGGTGACGAGGCCGAC<br>TACTACTGCCATATCT<br>GGGACAGCAGAGTTCC<br>CACCAAGTGGGTCTTT<br>GGAGGCGGAACCACCT<br>TGACCGTGCTGGGACA<br>GCCTAAGGCCGCTCCT<br>TCCGTGACCCTGTTCC<br>CTCCATCCTCCGAGGA<br>ACTGCAGGCCAACAAG<br>GCCACCCTCGTGTGCC<br>TGATCTCCGACTTCTA<br>CCCTGGCGCCGTGACC<br>GTGGCCTGGAAGGCTG<br>ATAGCTCCTGTGAA<br>GGCCGCGTGGAAACC<br>ACCACCCTTCCAAGC<br>AGTCAACAACAAATA<br>CGCCGCCTCCTCCTAC<br>CTGTCCCTGACCCCTG<br>AGCAGTGGAAGTCCCA<br>CCGGTCCTACAGCTGC<br>CAAGTGACCCACGAGG<br>GCTCCACCGTGGAAAA<br>GACCGTGGCTCCTACC<br>GAGTGCTCC |
| 444 hPGT1 21.66 AAS + W/huSP 34.39.13 scFv AAS + SAV + R | SEQ ID NO: 1024<br>GAGGTGCAGCTGGTGGAATCTGGCGGAGGATTG<br>GTTCAGCCTGGCGGCTCTCTGAGACTGTCTTGT<br>GCCGCTTCTGGCTTCACCTTCAACACCTACGCC<br>ATGAACTGGGTCCGACAGGCTCCTGGCAAAGGC<br>CTGGAATGGGTCGGACGGATCCGGTCCAAGTAC<br>AACAATTACGCCACCTACTACGCCGACTCCGTG<br>AAGAGCAGATTCACCATCTCTCGGGACGACTCC<br>AAGAACTCCCTGTACCTGGAGATGAACAGCCTG<br>CGGACCGAGGATACCGCCGTGTACTATTGTGTG<br>CGGCACGGCAACTTCGGCCACTCCTATGTGTCT<br>TGGTTTGCCTACTGGGGCCAGGGCACACTGGTC<br>ACAGTTTCTTCCGGCGGAGGTGGAAGCGGAGGC<br>GGAGGTAGTGGCGGTGGTGGTTCAGGTGGTGGT<br>GGATCTCAGGCTGTGGTTACCCAGGAGCCTAGC<br>CTGACAGTTTCTCCTGGCGGCACCGTGACACTG<br>ACCTGTGGATCTTCTACCGGCGCTGTGACCACC<br>GGCCATTACGCTAATTGGGTGCAGCAGAAGCCT<br>GGACAGGCCCCAAGAGGACTGATCGGCGGCACA<br>TCTAACAGAGCCCCTGGCGTCCCAGCCAGATTC<br>TCTGGATCTCTGCTTGGCGGCAAGGCCGCTCTG<br>ACAATTTCTGGTGCTCAGCCTGAGGACGAGGCC<br>GAGTACTACTGTGCCCTGTGGTACTCCAACAGA<br>TGGGTGTTCGGCGGAGGCACCAAGCTGACAGTG<br>TTGGAGCCCAAATCTTCAGACAAGACCCACACC<br>TGTCCTCCATGTCCTGCTCCAGAAGCTGCTGGC<br>GGCCCTTCCGTGTTTCTGTTCCCTCCAAAGCCT | SEQ ID NO: 1025<br>CAGATGCAGCTGCAGGAATCTGGCCCTGGCCTC<br>GTGAAGCCCTCCGAGACACTGTCCCTGACCTGC<br>TCTGTGTCCGGCGCCTCCATCTCCGACTCCTAC<br>TGGTCTTGGATCCGGCGATCCCCTGGCAAGGGC<br>CTGGAATGGATCGGCTACGTGCACAAGTCCGGC<br>GACACCAACTACAATCCCAGCCTGAAGTCCAGA<br>GTGCACCTGTCCCTGGACACCTCCAAGAACCAG<br>GTGTCCCTGTCTCTGACTGGTGTCACCGCTGCT<br>GACTCCGGCAAGTACTACTGCGCCAGAACCCTG<br>CACGGCCAGACGGATCTACGGCATCGTGGCCTTC<br>AACGAGTGGTTCACCTACTTCTACATGGACGTG<br>TGGGGCACCGGCACCCAAGTGACCGTGTCCTCT<br>GCCTCTACAAAGGGCCCTAGTGTGTTCCCTCTG<br>GCTCCCAGCAGCAAGTCTACATCTGGCGGAACA<br>GCCGCTCTGGGCTGCCTGGTCAAGGATTACTTT<br>CCCGAGCCTGTGACCGTGTCCTGGAATTCTGGC<br>GCTCTGACAAGCGGCGTGCACACCTTTCCAGCT<br>GTGCTGCAAAGCAGCGGCCTGTACTCTCTGAGC<br>AGCGTGGTCACAGTGCCTAGCTCTAGCCTGGGC<br>ACCCAGACCTACATCTGCAATGTGAACCACAAG<br>CCTAGCAACACCAAGGTGGACAAGAAGGTGGAA<br>CCCAAGAGCTGCGACAAGACCCACACCTGTCCT<br>CCATGTCCTGCTCCAGAAGCTGCTGGCGGCCCT<br>TCCGTGTTTCTGTTCCCTCCAAAGCCTAAGGAC<br>ACCCTGATGATCAGCAGAACCCCTGAAGTGACC<br>TGCGTGGTGGTGGATGTGTCCCACGAGGATCCC | SEQ ID NO: 1023<br>AGCGACATCAGCGTGG<br>CCCCAGGCGAGACCGC<br>CAGGATCAGCTGCGGC<br>GAGAAGAGCCTGGGCA<br>GCAGGGCCGTGCAATG<br>GTATCAGCACAGGGCA<br>GGCCAGGCCCCCAGCC<br>TGATCATCTACAACAA<br>CCAGGACAGGCCCAGC<br>GGCATCCCCGAGAGGT<br>TCAGTGGCAGCCCCGA<br>CTTCAGGCCCGGTACC<br>ACAGCCACCCTGACCA<br>TCACCTCAGTGGAGGC<br>CGGTGACGAGGCCGAC<br>TACTACTGCCATATCT<br>GGGACAGCAGAGTTCC<br>CACCAAGTGGGTCTTT<br>GGAGGCGGAACCACCT<br>TGACCGTGCTGGGACA<br>GCCTAAGGCCGCTCCT<br>TCCGTGACCCTGTTCC<br>CTCCATCCTCCGAGGA<br>ACTGCAGGCCAACAAG<br>GCCACCCTCGTGTGCC<br>TGATCTCCGACTTCTA |

TABLE J-continued polynucleotide encoding three chains of illustrative CD3/gp120-targeting bi-specific binding molecules

| Ab name | unpaired HC | Fab Arm - HC | Fab Arm - LC |
|---|---|---|---|
| | AAGGACACCCTGATGATCAGCAGAACCCCTGAA | GAAGTGAAGTTCAATTGGTACGTGGACGGCGTG | CCCTGGCGCCGTGACC |
| | GTGACCTGCGTGGTGGTGGATGTGTCCCACGAG | GAAGTGCACAACGCCAAGACCAAGCCTAGAGAG | GTGGCCTGGAAGGCTG |
| | GATCCCGAAGTGAAGTTCAATTGGTACGTGGAC | GAACAGTACAACAGCACCTACAGAGTGGTGTCC | ATAGCTCTCCTGTGAA |
| | GGCGTGGAAGTGCACAACGCCAAGACCAAGCCT | GTGCTGACCGTGCTGCACCAGGATTGGCTGAAC | GGCCGGCGTGGAAACC |
| | AGAGAGGAACAGTACAACAGCACCTACAGAGTG | GGCAAAGAGTACAAGTGCAAGGTGTCCAACAAG | ACCACCCCTTCCAAGC |
| | GTGTCCGTGCTGACCGTGCTGCACCAGGATTGG | GCCCTGCCTGCCAGCATCGAGAAAACCATCAGC | AGTCCAACAACAAATA |
| | CTGAACGGCAAAGAGTACAAGTGCAAGGTGTCC | AAGGCCAAGGGCCAGCCTAGGGAACCCCAGGTT | CGCCGCCTCCTCCTAC |
| | AACAAGGCCCTGCCTGCCAGCATCGAGAAAACC | TACACACTGCCTCCAAGCCGGGAAGAGATGACC | CTGTCCCTGACCCCTG |
| | ATCAGCAAGGCCAAGGGCCAGCCTAGGGAACCC | AAGAACCAGGTGTCCCTGTGGTGTCTGGTGAAG | AGCAGTGGAAGTCCCA |
| | CAGGTTTACACACTGCCTCCAAGCCGGGAAGAG | GGCTTCTACCCTTCCGATATCGCCGTGGAATGG | CCGGTCCTACAGCTGC |
| | ATGACCAAGAACCAGGTGTCCCTGAGCTGTGCC | GAGAGCAATGGCCAGCCTGAGAACAACTACAAG | CAAGTGACCCACGAGG |
| | GTGAAGGGCTTCTACCCTTCCGATATCGCCGTG | ACAACCCCTCCTGTGCTGGACAGCGACGGCTCA | GCTCCACCGTGGAAAA |
| | GAATGGGAGAGCAATGGCCAGCCTGAGAACAAC | TTCTTCCTGTACTCCAAGCTGACAGTGGACAAG | GACCGTGGCTCCTACC |
| | TACAAGACAACCCCTCCTGTGCTGGACAGCGAC | TCCAGATGGCAGCAGGGCAACGTGTTCAGCTGC | GAGTGCTCC |
| | GGCTCATTCTTCCTGGTGTCCAAGCTGACAGTG | AGCGTGATGCACGAGGCCCTGCACAACCACTAC | |
| | GACAAGTCCAGATGGCAGCAGGGCAACGTGTTC | ACCCAGAAGTCCCTGTCTCTGAGCCCCGGCAAA | |
| | AGCTGCAGCGTGATGCACGAGGCCCTGCACAAC | | |
| | CGGTACACCCAGAAGTCCCTGTCTCTGAGCCCC | | |
| | GGCAAA | | |

In some embodiments, the one or more polynucleotides encoding the antibodies or antigen-binding fragments, described herein, are formulated or encapsulated in a lipoplex, e.g., a lipid nanoparticle (LNP). As used herein, a "lipoplex" refers to cationic liposomes that are nonviral (synthetic) lipid carriers of DNA. In some embodiments the lipoplex is a lipid nanoparticle (LNP). As used herein, the term "lipid nanoparticle" refers to one or more spherical nanoparticles with an average diameter of between 10 to 1000 nanometers, and which comprise a solid lipid core matrix that can solubilize lipophilic molecules. In certain embodiments, the lipid core is stabilized by surfactants (e.g., emulsifiers), and can comprise one or more of triglycerides (e.g., tristearin), diglycerides (e.g., glycerol bahenate), monoglycerides (e.g., glycerol monostearate), fatty acids (e.g., stearic acid), steroids (e.g., cholesterol), and waxes (e.g., cetyl palmitate), including combinations thereof. Lipid nanoparticles are described, for example, in Petrilli et al., Curr Pharm Biotechnol. 15:847-55, 2014; and U.S. Pat. Nos. 6,217,912; 6,881,421; 7,402,573; 7,404,969; 7,550,441; 7,727,969; 8,003,621; 8,691,750; 8,871,509; 9,017,726; 9,173,853; 9,220,779; 9,227,917; and 9,278,130, each of which is incorporated by reference in its entirety. LNP-encapsulated mRNA molecules encoding a broadly neutralizing antibody are described, e.g., in Pardi, et al., *Nat Commun*. (2017) 8:14630. In certain embodiments, the one or more polynucleotides encoding the antibodies or antigen-binding fragments, described herein, are formulated or encapsulated in an LNP comprised of an ionizable cationic lipid/phosphatidylcholine/cholesterol/PEG-lipid, e.g., in molar ratios of about 50:10:38.5:1.5 mol mol$^{-1}$, respectively.

7. Vectors and Host Cells

Further provided are vectors comprising one or more polynucleotides encoding one or more of the multi-specific antigen binding molecules, described herein. A vector can be of any type, for example, a recombinant vector such as an expression vector. Vectors include, but are not limited to, plasmids, cosmids, bacterial artificial chromosomes (BAC) and yeast artificial chromosomes (YAC) and vectors derived from bacteriophages or plant or animal (including human) viruses. Vectors can comprise an origin of replication recognized by the proposed host cell (e.g., including prokaryotic and eukaryotic host cells) and in the case of expression vectors, promoter and other regulatory regions recognized by the host cell. In additional embodiments, a vector comprises a polynucleotide encoding an antibody of the disclosure operably linked to a promoter and optionally additional regulatory elements. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome. Vectors include, but are not limited to, those suitable for recombinant production of the antibodies disclosed herein.

The choice of the vector is dependent on the recombinant procedures followed and the host used. Introduction of vectors into host cells can be effected by inter alia calcium phosphate transfection, virus infection, DEAE-dextran-mediated transfection, lipofectamine transfection or electroporation. Vectors may be autonomously replicating or may replicate together with the chromosome into which they have been integrated. In certain embodiments, the vectors contain one or more selection markers. The choice of the markers may depend on the host cells of choice. These include, but are not limited to, kanamycin, neomycin, puromycin, hygromycin, zeocin, ampicillin (AmpR), thymidine kinase gene from Herpes simplex virus (HSV-TK), mammalian glutamine synthetase (GS) and dihydrofolate reductase gene from mouse (dhfr). Vectors comprising one or more nucleic acid molecules encoding the antibodies described herein, operably linked to one or more nucleic acid molecules encoding proteins or peptides that can be used to isolate the antibodies, are also covered by the disclosure. These proteins or peptides include, but are not limited to, glutathione-S-transferase, maltose binding protein, metal-binding polyhistidine, green fluorescent protein, luciferase and beta-galactosidase. In other embodiments, the vector that is used is or is based on pcDNA™3.1+ (ThermoFisher, MA) or pCGS3. In various embodiments, the vector can have one, two, three, four or five open reading frames or expression cassettes. In various embodiments, the vector can have one, two, three, four or five cistrons. In some embodiments, the first, second and third expression cassettes (e.g., as set forth below) each comprise a promoter of identical or equivalent transcription strength. In varying embodiments, the promoter is a constitutive promoter. In some embodiments, the first, second and third expression cassettes (e.g., as set forth below) comprise one or more promoters of different transcription strength. Illustrative promoters of use include without limitation cytomegalovirus (CMV), SV40, RSV, EF1a, UBC, PGK and CAGG (see, e.g., Qin, et al., *PLoS One*. (2010) 5(5):e10611). In embodiments, the expression vector further comprises a fourth expression cassette positioned 5' to the first expression cassette comprising a polynucleotide encoding a eukaryotic selection marker protein, e.g., glutamine synthetase (GS). Generally, the promoter driving expression of the polynucleotide encoding a eukaryotic selection marker protein (fourth expression cassette) has a relatively weaker transcription strength in comparison to the promoters driving expression of the polynucleotide in the first, second and third expression cassettes.

In some embodiments, the expression vector or expression vectors comprise a plasmid vector or a viral vector. In some embodiments, the expression vector comprises three, four or five expression cassettes or cistrons. In some embodiments, the expression vector comprises, optionally in sequential order from 5' to 3': (i) a first expression cassette comprising a first polynucleotide encoding an anti-HIV gp120 VL-light chain constant domain (CL) fusion protein; (ii) a second expression cassette comprising a second polynucleotide encoding an anti-HIV gp120 VH-Fc fusion protein; and (iii) a third expression cassette comprising a third polynucleotide encoding an anti-CD3 scFv-Fc fusion protein. In some embodiments, the anti-HIV gp120 VL-CL fusion protein, the anti-HIV gp120 VH-Fc fusion protein and the anti-CD3 scFv-Fc fusion protein comprise amino acid sequences set forth, respectively, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 802, 801 and 800; SEQ ID NOs: 802, 803 and 800; SEQ ID NOs: 802, 803 and 804; SEQ ID NOs: 802, 805 and 804; SEQ ID NOs: 802, 801 and 806; SEQ ID NOs: 802, 803 and 806; SEQ ID NOs: 802, 803 and 807; SEQ ID NOs: 802, 805 and 807; SEQ ID NOs: 802, 809 and 808; SEQ ID NOs: 802, 810 and 808; SEQ ID NOs: 802, 801 and 811; SEQ ID NOs: 802, 809 and 812; SEQ ID NOs: 802, 810 and 812; SEQ ID NOs: 802, 805 and 813; SEQ ID NOs: 802, 814 and 812; SEQ ID NOs: 802, 801 and 815; SEQ ID NOs: 802, 805 and 816; SEQ ID NOs: 802, 801 and 817; SEQ ID NOs: 802, 805 and 818; SEQ ID NOs: 802, 810 and 819; SEQ ID NOs: 802, 810 and 820; SEQ ID NOs: 823, 822 and 821; SEQ ID NOs: 823, 825 and 824; SEQ ID NOs: 823, 825 and 826; SEQ ID NOs: 823, 827 and 826; SEQ ID NOs: 823, 829 and 828; SEQ ID NOs: 823, 822 and 830; SEQ ID NOs: 823, 825 and 830; SEQ ID NOs: 823, 825 and 831; SEQ ID NOs: 823, 827 and 831; SEQ ID NOs: 823, 833 and 832; SEQ ID NOs: 823, 829 and 832; SEQ ID NOs: 823, 827 and 834; SEQ ID NOs: 823, 829 and 835; SEQ ID NOs: 823, 829 and 836; SEQ ID NOs: 823, 833 and 837; SEQ ID NOs: 823, 838 and 837; SEQ ID NOs: 823, 840 and 839; SEQ ID NOs: 823, 829 and 841; SEQ ID NOs: 823, 829 and 842; SEQ ID NOs: 823, 829 and 843; SEQ ID NOs: 823, 829 and 844; SEQ ID NOs: 823, 829 and 845; SEQ ID NOs: 823, 829 and 846; SEQ ID NOs: 823, 833 and 846; SEQ ID NOs: 823, 838 and 846; SEQ ID NOs: 823, 827 and 847; SEQ ID NOs: 823, 829 and 848; SEQ ID NOs: 823, 829 and 849; SEQ ID NOs: 823, 829 and 850; SEQ ID NOs: 823, 829 and 851; SEQ ID NOs: 823, 829 and 852; SEQ ID NOs: 823, 829 and 853; SEQ ID NOs: 823, 829 and 854; SEQ ID NOs: 823, 829 and 855; SEQ ID NOs: 823, 829 and 856; SEQ ID NOs: 823, 829 and 857; SEQ ID NOs: 823, 829 and 858; SEQ ID NOs: 823, 829 and 859; SEQ ID NOs: 823, 829 and 860; SEQ ID NOs: 863, 862 and 861; SEQ ID NOs: 863, 864 and 861; SEQ ID NOs: 863, 864 and 865; SEQ ID NOs: 863, 866 and 865; SEQ ID NOs: 863, 868 and 867; SEQ ID NOs: 863, 862 and 869; SEQ ID NOs: 863, 864 and 869; SEQ ID NOs: 863, 864 and 870; SEQ ID NOs: 863, 866 and 870; SEQ ID NOs: 863, 872 and 871; SEQ ID NOs: 863, 868 and 871; SEQ ID NOs: 863, 862 and 873; SEQ ID NOs: 863, 866 and 874; SEQ ID NOs: 863, 872 and 875; SEQ ID NOs: 863, 868 and 875; SEQ ID NOs: 863, 876 and 875; SEQ ID NOs: 863, 862 and 877; SEQ ID NOs: 863, 866 and 878; SEQ ID NOs: 863, 862 and 879; SEQ ID NOs: 863, 866 and 880; SEQ ID NOs: 883, 882 and 881; SEQ ID NOs: 883, 884 and 881; SEQ ID NOs: 883, 884 and 885; SEQ ID NOs: 883, 886 and 885; SEQ ID NOs: 883, 888 and 887; SEQ ID NOs: 883, 882 and 889; SEQ ID NOs: 883, 884 and 889; SEQ ID NOs: 883, 884 and 890; SEQ ID NOs: 883, 886 and 890; SEQ ID NOs: 883, 892 and 891; SEQ ID NOs: 883, 888 and 891; SEQ ID NOs: 883, 882 and 893; SEQ ID NOs: 883, 886 and 894; SEQ ID NOs: 883, 892 and 895; SEQ ID NOs: 883, 888 and 895; SEQ ID NOs: 883, 896 and 895; SEQ ID NOs: 883, 882 and 897; SEQ ID NOs: 883, 886 and 898; SEQ ID NOs: 883, 882 and 899; or SEQ ID NOs: 883, 886 and 900.

In some embodiments, the expression vector comprises, optionally in sequential order from 5' to 3': (i) a first expression cassette comprising a first polynucleotide encoding an anti-CD3 VL-CL fusion protein; (ii) a second expression cassette comprising a second polynucleotide encoding an anti-CD3 VH-Fc fusion protein; and (iii) a third expression cassette comprising a third polynucleotide encoding a CD4 extracellular (EC) domain-Fc fusion protein. In some embodiments, the anti-CD3 VL-CL fusion protein, the anti-CD3 VH-Fc fusion protein and the CD4 EC domain-Fc fusion protein comprise amino acid sequences set forth, respectively, below, or comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively, below: SEQ ID NOs: 753, 752 and 751; SEQ ID NOs: 753, 752 and 754; SEQ ID NOs: 753, 756 and 755; SEQ ID NOs: 753, 757 and 755; SEQ ID NOs: 753, 757 and 758; SEQ ID NOs: 753, 756 and 759; SEQ ID NOs: 761, 760 and 754; SEQ ID NOs: 761, 760 and 762; SEQ ID NOs: 753, 763 and 751; SEQ ID NOs: 753, 752 and 764; SEQ ID NOs: 753, 752 and 765; SEQ ID NOs: 753, 767 and 766; SEQ ID NOs: 753, 768 and 766; SEQ ID NOs: 753, 768 and 769; SEQ ID NOs: 753, 767 and 770; SEQ ID NOs: 761, 771 and 765; SEQ ID NOs: 761, 771 and 772; SEQ ID NOs: 776, 775 and 774; SEQ ID NOs: 776, 778 and 777; SEQ ID NOs: 776, 778 and 779; SEQ ID NOs: 776, 780 and 779; SEQ ID NOs: 776, 781 and 777; SEQ ID NOs: 753, 752 and 782; SEQ ID NOs: 753, 752 and 783; SEQ ID NOs: 753, 785 and 784; SEQ ID NOs: 753, 786 and 784; SEQ ID NOs: 753, 786 and 787; SEQ ID NOs: 753, 785 and 788; SEQ ID NOs: 761, 789 and 783; SEQ ID NOs: 761, 789 and 790; SEQ ID NOs: 794, 793 and 792; SEQ ID NOs: 794, 796 and 795; SEQ ID NOs: 794, 796 and 797; SEQ ID NOs: 794, 798 and 797; or SEQ ID NOs: 794, 799 and 795. In some embodiments, the anti-CD3

VL-CL fusion protein, the anti-CD3 VH-Fc fusion protein and the CD4 EC domain-Fc fusion protein comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 753, 752 and 751. In some embodiments, the anti-CD3 VL-CL fusion protein, the anti-CD3 VH-Fc fusion protein and the CD4 EC domain-Fc fusion protein comprise amino acid sequences set forth, respectively: SEQ ID NOs: 753, 752 and 751.

In some embodiments, the anti-CD3 VL-CL fusion protein, the anti-CD3 VH-Fc fusion protein and the CD4 EC domain-Fc fusion protein comprise amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 753, 752 and 751. In some embodiments, the anti-CD3 VL-CL fusion protein, the anti-CD3 VH-Fc fusion protein and the CD4 EC domain-Fc fusion protein comprise amino acid sequences that are at least 95% identical to the amino acid sequences set forth, respectively: SEQ ID NOs: 753, 752 and 751. In some embodiments, the anti-CD3 VL-CL fusion protein, the anti-CD3 VH-Fc fusion protein and the CD4 EC domain-Fc fusion protein comprise amino acid sequences that are at least 99% identical to the amino acid sequences set forth, respectively: SEQ ID NOs: 753, 752 and 751. In some embodiments, the anti-CD3 VL-CL fusion protein comprises an amino acid sequence that is at least 95% (e.g., 99%) identical to the amino acid sequence of SEQ ID NO: 753, the anti-CD3 VH-Fc fusion protein comprises an amino acid sequence that is at least 95% (e.g., 99%) identical to the amino acid sequence of SEQ ID NO: 752, and the CD4 EC domain-Fc fusion protein comprises an amino acid sequence that is at least 95% (e.g., 99%) identical to the amino acid sequence of SEQ ID NO: 751. In some embodiments, the anti-CD3 VL-CL fusion protein comprises an amino acid sequence that is at least 95% identical to the amino acid sequence of SEQ ID NO: 753, the anti-CD3 VH-Fc fusion protein comprises an amino acid sequence of SEQ ID NO: 752, and the CD4 EC domain-Fc fusion protein comprises an amino acid sequence that is at least 95% (e.g., 99%) identical to the amino acid sequence of SEQ ID NO: 751. In some embodiments, the anti-CD3 VL-CL fusion protein comprises an amino acid sequence that is at least 99% identical to the amino acid sequence of SEQ ID NO: 753, the anti-CD3 VH-Fc fusion protein comprises an amino acid sequence of SEQ ID NO: 752, and the CD4 EC domain-Fc fusion protein comprises an amino acid sequence that is at least 95% (e.g., 99%) identical to the amino acid sequence of SEQ ID NO: 751. In some embodiments, the anti-CD3 VL-CL fusion protein comprises an amino acid sequence of SEQ ID NO: 753, the anti-CD3 VH-Fc fusion protein comprises an amino acid sequence that is at least 95% identical to the amino acid sequence of SEQ ID NO: 752, and the CD4 EC domain-Fc fusion protein comprises an amino acid sequence that is at least 95% (e.g., 99%) identical to the amino acid sequence of SEQ ID NO: 751. In some embodiments, the anti-CD3 VL-CL fusion protein comprises an amino acid sequence of SEQ ID NO: 753, the anti-CD3 VH-Fc fusion protein comprises an amino acid sequence that is at least 99% identical to the amino acid sequence of SEQ ID NO: 752, and the CD4 EC domain-Fc fusion protein comprises an amino acid sequence that is at least 95% (e.g., 99%) identical to the amino acid sequence of SEQ ID NO: 751. In some embodiments, the anti-CD3 VL-CL fusion protein, the anti-CD3 VH-Fc fusion protein and the CD4 EC domain-Fc fusion protein comprise amino acid sequences set forth, respectively: SEQ ID NOs: 753, 752 and 751.

The disclosure also provides host cells comprising one or more recombinant polynucleotides or one or more vectors, as described herein. Any of a variety of host cells can be used. In one embodiment, a host cell is a prokaryotic cell, for example, E. coli. In another embodiment, a host cell is a eukaryotic cell, for example, a yeast cell, a plant cell, an insect cell, a mammalian cell, such as a Chinese Hamster Ovary (CHO)-based or CHO-origin cell (e.g., CHO-S, CHO DG44, ExpiCHO™, CHOZN® ZFN-modified GS-/- CHO cell line or CHO-K1, CHO-K1a cells), COS cells, BHK cells, NS0 cells or Bowes melanoma cells. Examples of human host cells are, inter alia, HeLa, 911, AT1080, A549, 293, Expi293™ and HEK293T-cells.

The terms "polynucleotide" and "nucleic acid molecule" interchangeably refer to a polymeric form of nucleotides and includes both sense and anti-sense strands of RNA, cDNA, genomic DNA, and synthetic forms and mixed polymers of the above. As used herein, the term nucleic acid molecule may be interchangeable with the term polynucleotide. In some embodiments, a nucleotide refers to a ribonucleotide, deoxynucleotide or a modified form of either type of nucleotide, and combinations thereof. The terms also include, but are not limited to, single- and double-stranded forms of DNA. In addition, a polynucleotide, e.g., a cDNA or mRNA, may include either or both naturally occurring and modified nucleotides linked together by either or both of naturally occurring and non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analogue, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. A reference to a nucleic acid sequence encompasses its complement unless otherwise specified. Thus, a reference to a nucleic acid molecule having a particular sequence should be understood to encompass its complementary strand, with its complementary sequence. The term also includes codon-biased polynucleotides for improved expression in a desired host cell.

The term "operably linked" refers to two or more nucleic acid sequence elements that are usually physically linked and are in a functional relationship with each other. For instance, a promoter is operably linked to a coding sequence if the promoter is able to initiate or regulate the transcription or expression of a coding sequence, in which case, the coding sequence should be understood as being "under the control of" the promoter.

A "substitution," as used herein, denotes the replacement of one or more amino acids or nucleotides by different amino acids or nucleotides, respectively.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location. "Isolated nucleic acid encoding an multi-specific antigen binding domain or fragment thereof" refers to one or more nucleic acid molecules encoding first antigen binding domain, and optionally second antigen binding domain, antibody heavy and light chains (or fragments thereof), including such nucleic acid molecule(s) in a single vector or separate vectors, and such nucleic acid molecule(s) present at one or more locations in a host cell.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Some vectors are suitable for delivering the nucleic acid molecule or polynucleotide of the present application. Certain vectors are capable of directing the expression of nucleic acids to which they are operatively linked.

Such vectors are referred to herein as expression vectors.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

A polynucleotide "variant," as the term is used herein, is a polynucleotide that typically differs from a polynucleotide specifically disclosed herein in one or more substitutions, deletions, additions and insertions. Such variants may be naturally occurring or may be synthetically generated, for example, by modifying one or more of the polynucleotide sequences described herein and evaluating one or more biological activities of the encoded polypeptide as described herein, e.g., using any of a number of techniques well known in the art.

A polypeptide "variant," as the term is used herein, is a polypeptide that typically differs from a polypeptide specifically disclosed herein in one or more substitutions, deletions, additions and insertions. Such variants may be naturally occurring or may be synthetically generated, for example, by modifying one or more of the above polypeptide sequences described herein and evaluating one or more biological activities of the polypeptide as described herein, e.g., using any of a number of techniques well known in the art.

The term "variant" may also refer to any naturally occurring or engineered molecule comprising one or more nucleotide or amino acid mutations. In one embodiment, the multi-specific antigen binding molecule is a bispecific antigen binding molecule. In one embodiment, the multi-specific antigen binding molecule is a bispecific antibody. For example, somatic variants may encompass all related naturally occurring antibodies that are part of or derived from the same B-cell lineage. Engineered variants may encompass all single mutations or combinatorial mutations made to an antibody.

8. Methods of Producing Multi-Specific Antigen Binding Molecules

Multi-specific and bispecific antigen binding molecules that bind to an HIV antigen (e.g., gp120, gp41) and human CD3 (e.g., human CD3c or human CD3δ) can be produced by any method known in the art for the synthesis of multi-specific antibodies, for example, by chemical synthesis or by recombinant expression techniques.

Methods of making monospecific antibodies are known. Methods of making bispecific antibodies are known and described, for example, in PCT Publ. Nos. WO2011/038290; WO2012/158818, WO2012/162067, WO2015/104346, WO2016/086189, WO2016/182751, WO2017/009442, WO2017/125897, WO2017/136659, WO2017/157305, WO2017/201493, WO2018/183139, WO2018/191438, WO2019/034580, WO2019/078697 and WO2019/143636; U.S. Pat. Nos. 5,731,168; 5,807,706; 5,821,333; and U.S. Appl. Publ. Nos. 2003/020734, 2002/0155537, 2014/242079, 2015/133640, 2016/297885 and 2017/037130. Bispecific tetravalent antibodies, and methods of making them are described, e.g., in WO 02/096948 and WO 00/44788, the disclosures of both of which are herein incorporated by reference in its entirety. In addition, other publications relating to making bispecific antibodies include WO 91/00360; WO 92/08802; WO 92/05793, and WO 93/17715; Tutt et al., J. Immunol. 147:60-69 (1991); U.S. Pat. Nos. 4,474,893; 4,714,681; 4,925,648; 5,573,920; 5,601,819, 9,212,230 and 9,701,759; and Kostelny et al., J. Immunol. 148:1547-1553 (1992). Heterodimeric bispecific antibodies having an scFv first antigen binding domain and a Fab second antigen binding domain are described, e.g., in WO 2013/163427 and in U.S. Pat. No. 9,701,759.

One method of making bispecific antibodies and the multi-specific antigen binding molecules described herein employs so-called "knobs-into-holes" technology (Ridgway et al., Protein Eng., 9:617-621 (1996); WO 2006/028936). The mispairing problem of Ig heavy chains that is a chief drawback for making bispecific antibodies is reduced in this technology by mutating selected amino acids forming the interface of the CH3 domains in IgG. At positions within the CH3 domain at which the two heavy chains interact directly, an amino acid with a small side chain (hole) is introduced into the sequence of one heavy chain and an amino acid with a large side chain (knob) into the counterpart interacting residue location on the other heavy chain. In some instances, multi-specific antigen binding molecules described herein have immunoglobulin chains in which the CH3 domains have been modified by mutating selected amino acids that interact at the interface between two polypeptides so as to preferentially form a bispecific antigen binding molecule. In some embodiments, the multi-specific antigen binding molecules can be composed of immunoglobulin chains of the same subclass or different subclasses. In one instance, a multi-specific antigen binding molecule that binds to gp120 and CD3 comprises a T366W (EU numbering) mutation in the "knobs chain" and T366S, L368A, Y407V (EU numbering) mutations in the "hole chain." In certain embodiments, an additional interchain disulfide bridge is introduced between the CH3 domains by, e.g., introducing a Y349C mutation into the "knobs chain" and a E356C mutation or a S354C mutation into the "hole chain." In certain embodiments, R409D, K370E mutations are introduced in the "knobs chain" and D399K, E357K mutations in the "hole chain." In other embodiments, Y349C, T366W mutations are introduced in one of the chains and E356C, T366S, L368A, Y407V mutations in the counterpart chain. In some embodiments. Y349C, T366W mutations are introduced in one chain and S354C, T366S, L368A, Y407V mutations in the counterpart chain. In some embodiments, Y349C, T366W mutations are introduced in one chain and S354C, T366S, L368A, Y407V mutations in the counterpart chain. In yet other embodiments, Y349C, T366W mutations are introduced in one chain and S354C, T366S, L368A, Y407V mutations in the counterpart chain (all EU numbering).

Another exemplary method of making bispecific antibodies is by using the Bispecific T-cell Engagers (BiTEs®) platform. BiTEs are made by genetically fusing a first scFv (e.g., a scFv that binds gp120) to a second scFv (e.g., a scFv that binds human CD3) via a flexible peptide linker (e.g., GGGGS (SEQ ID NO: 1088)). See, e.g., Staerz et al., Nature, 314:628-631 (1985); Mack et al., PNAS, 92:7021-7025 (1995); Huehls et al., Immunol. Cell Biol., 93:290-296 (2015).

Another exemplary method of making bispecific antibodies is by using the Dual-Affinity Re-targeting (DART) platform. This technology is based on the diabody format of Holliger et al. (PNAS, 90:6444-6448 (1993)) and further improved for stability and optimal pairing of the VH and VL chains (Johnson et al., J Mol. Biol., 399: 436-449 (2010); Sung et al., J Clin Invest., 125(11): 4077-4090 (2015)).

Yet another exemplary method of making bispecific antibodies is by using the Trifunctional Hybrid Antibodies platform—Triomab®. This platform employs a chimeric construction made up of half of two full-length antibodies of different isotypes, mouse IgG2a and rat IgG2b. This technology relies on species-preferential heavy/light chain pairing associations. See, Lindhofer et al., J Immunol., 155:219-225 (1995).

A further exemplary method of making bispecific antibodies is by using the TandAb® platform. This technology is based on the diabody concept but are designed as a single polypeptide chain VH1-VL2-VH2-VL1 comprising short linkers to prevent intra-chain pairing. Head-to-tail dimerization of this single chain results in the formation of a tetravalent homodimer (Kipriyanov et al., J Mol. Biol., 293: 41-56 (1999)).

Yet another method for making bispecific antibodies is the CrossMab technology. CrossMab are chimeric antibodies constituted by the halves of two full-length antibodies. For correct chain pairing, it combines two technologies: (i) the knob-into-hole which favors a correct pairing between the two heavy chains; and (ii) an exchange between the heavy and light chains of one of the two Fabs to introduce an asymmetry which avoids light-chain mispairing. See, Ridgway et al., Protein Eng., 9:617-621 (1996); Schaefer et al., PNAS, 108:11187-11192 (2011). CrossMabs can combine two or more antigen binding domains for targeting two or more targets or for introducing bivalency towards one target such as the 2:1 format.

In various embodiments, the multi-specific antigen binding molecules described herein may be produced in bacterial or eukaryotic cells. The multi-specific antigen binding molecules can also be produced in eukaryotic cells such as transformed cell lines (e.g., CHO, CHO-S, 293E, 293T, Expi293™, COS, NIH3T3). In addition, the multi-specific antigen binding molecules described herein (e.g., Fabs, Fab-scFv, scFv's) can be expressed in a yeast cell such as Pichia (see, e.g., Powers et al., J Immunol Methods. 251: 123-35 (2001)), Hanseula, or Saccharomyces. In one embodiment, the bispecific antibodies described herein are produced in a CHO-based or CHO-origin cell line (e.g., CHO-S, CHO DG44, ExpiCHO™, CHOZN® ZFN-modified GS-/- CHO cell line or CHO-K1, CHO-K1a) or a HEK293 (e.g., Expi293™) cell line. To produce the multi-specific antigen binding molecules of interest, one or more polynucleotides encoding the multi-specific antigen binding molecules is constructed, introduced into an expression vector, and then expressed in one or more suitable host cells. In some embodiments, three polynucleotides encoding an scFv heavy chain comprising the first antigen binding domain, a Fab heavy chain and a Fab light chain comprising the second antigen binding domain are co-expressed in a single host cell. In some embodiments, three polynucleotides encoding a Fab heavy chain and a Fab light chain comprising the first antigen binding domain, and an EC domain comprising the second antigen binding domain are co-expressed in a single host cell. Standard molecular biology techniques are used to prepare the recombinant expression vector, transfect the host cells, select for transformants, culture the host cells, and recover the multi-specific antigen binding molecules.

In some embodiments, the host cell predominantly sialylates N-linked glycosylation sites within the variable regions of an immunoglobulin antigen binding domain. In some embodiments, the polynucleotides encoding a multi-specific antigen binding molecule, as described herein, are expressed in a host cell that sialylates at least 50%, at least 55%, at least 60%, at least 65%, at least 70%, at least 75%, at least 80%, at least 85%, at least 90%, at least 91%, at least 92%, at least 93%, at least 94%, at least 95%, or more, N-linked glycosylation sites in the variable domains (Fv) of expressed antigen binding molecules. In various embodiments, in multi-specific antigen binding molecules expressed from such host cells, at least 50%, at least 60%, at least 70%, least 80%, at least 85%, at least 90%, or more, N-linked glycosylation sites in at least one of the first VH, the first VL, the second VH and the second VL of the multi-specific antigen binding molecule are sialylated. In various embodiments, in multi-specific antigen binding molecules expressed from such host cells, the N-linked glycosylation sites in at least one of the first VL, the second VH and the second VL have a sialic acid occupancy (e.g., a glycan comprising one or two terminal sialic acid residues) of at least 40%, at least 50%, at least 60%, at least 70%, least 80%, at least 85%, at least 90%, or more. In some embodiments, the sialylated N-linked glycosylation sites in at least one of the first VL, the second VH and the second VL of the multi-specific antigen binding molecule comprise from 1 to 5 sialic acid residues, e.g., from 1 to 4 sialic acid residues, e.g., from 1 to 3 sialic acid residues, e.g., from 1 to 2 sialic acid residues. In some embodiments, at least one of the first VL, the second VH and the second VL are sialylated with N-acetyl-neuraminic acid (NANA). In some embodiments, the sialic acid residues are present in biantennary structures. In some embodiments, the sialic acid residues are present in complex N-linked glycan structures. In some embodiments, the sialic acid residues are present in hybrid N-linked glycan structures. In some embodiments, the glycans are terminally sialylated.

If the multi-specific antigen binding molecules are to be expressed in bacterial cells (e.g., E. coli), the expression vector should have characteristics that permit amplification of the vector in the bacterial cells. Additionally, when E. coli such as JM109, DH5a, HB101, or XL1-Blue is used as a host, the vector must have a promoter, for example, a lacZ promoter (Ward et al., 341:544-546 (1989), araB promoter (Better et al., Science, 240:1041-1043 (1988)), or T7 promoter that can allow efficient expression in E. coli. Examples of such vectors include, for example, M13-series vectors, pUC-series vectors, pBR322, pBluescript, pCR- Script, pGEX-5X-1 (Pharmacia), "QIAexpress system" (QIAGEN), pEGFP, and pET (when this expression vector is used, the host is preferably BL21 expressing T7 RNA polymerase). The expression vector may contain a signal sequence for secretion of the multi-specific antigen binding molecules. For production into the periplasm of E. coli, the pelB signal sequence (Lei et al., J. Bacteriol., 169: 4379 (1987)) may be used as the signal sequence for secretion of the multi-specific antigen binding molecules. For bacterial expression, calcium chloride methods or electroporation methods may be used to introduce the expression vector into the bacterial cell.

If the multi-specific antigen binding molecules are to be expressed in animal cells, e.g., such as CHO-based or CHO-origin cells, COS, and NIH3T3 cells, the expression vector includes a promoter useful for expression in these cells. In various embodiments, the promoter for expression of the multi-specific antigen binding molecules in mammalian cells is a constitutive promoter or an inducible promoter. Illustrative promoters for expression of the multi-specific antigen binding molecules in mammalian cells include without limitation an SV40 promoter (Mulligan et al., Nature, 277:108 (1979)), MMLV-LTR promoter, EF1α promoter (Mizushima et al., Nucleic Acids Res., 18:5322 (1990)), or CMV promoter. In addition to the nucleic acid sequence encoding the immunoglobulin or domain thereof, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399,216, 4,634,665 and 5,179,017). For example, typically the selectable marker gene confers resistance to drugs, such as G418, hygromycin, or methotrexate, on a host cell into which the vector has been introduced. Examples of vectors with selectable markers include pMAM, pDR2, pBK-RSV, pBK-CMV, pOPRSV, and pOP13.

In one embodiment, the multi-specific antigen binding molecules are produced in mammalian cells. Exemplary mammalian host cells for expressing multi-specific antigen binding molecules include Chinese Hamster Ovary (CHO cells) (including dhfr– CHO cells, e.g., described in Urlaub and Chasin (1980) Proc. Natl. Acad. Sci. USA 77: 4216-4220, used with a DHFR selectable marker, e.g., as described in Kaufman and Sharp (1982) Mol. Biol. 159:601 621 and glutamine synthetase (GS)– cells used with a GS selectable marker, e.g., described in Lin, et al., *MAbs*. (2019) 11(5):965-976; and Noh, et al., *Sci Rep*. (2018) 8(1):5361), human embryonic kidney 293 cells (e.g., 293, 293E, 293T, Expi293™), COS cells, NIH3T3 cells, lymphocytic cell lines, e.g., NS0 myeloma cells and SP2 cells, and a cell from a transgenic animal, e.g., a transgenic mammal. For example, the cell is a mammary epithelial cell. CHO and NS0 cell lines for recombinant antibody production are reviewed by Dhara, et al., *BioDrugs*. (2018) 32(6):571-584.

In an exemplary system for expression of the multi-specific antigen binding molecules, recombinant expression vectors encoding the first and second binding domains (e.g., VH and VL of an anti-CD3 targeting arm and VH and VL of an anti-gp120 targeting arm) are introduced into dhfr– CHO cells by calcium phosphate-mediated transfection. In a specific embodiment, the dhfr– CHO cells are cells of the DG44 cell line, such as DG44i (see, e.g., Derouaz et al., *Biochem Biophys Res Commun*., (2006) 340(4):1069-77). Within the recombinant expression vectors, the immunoglobulin heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vectors also carry a DHFR gene, which allows for selection of CHO cells that have been transfected with the vector using methotrexate selection/amplification. The selected transformant host cells are cultured to allow for expression of the immunoglobulin heavy and light chains and the multi-specific antigen binding molecule is recovered from the culture medium. In one embodiment, all three polypeptides of a bi-specific antigen binding molecule, as described herein, are expressed in a single cell. In one embodiment, all three polypeptides of a bi-specific antigen binding molecule, as described herein, are expressed in a single cell from a single vector.

The multi-specific antigen binding molecules can also be produced by a transgenic animal. For example, U.S. Pat. No. 5,849,992 describes a method of expressing an antibody in the mammary gland of a transgenic mammal. A transgene is constructed that includes a milk-specific promoter and one or more polynucleotides encoding the multi-specific antigen binding molecule of interest and a signal sequence for secretion. The milk produced by females of such transgenic mammals includes, secreted-therein, the multi-specific antigen binding molecule of interest. The multi-specific antigen binding molecule can be purified from the milk, or for some applications, used directly. Animals are also provided comprising one or more of the nucleic acids described herein.

The multi-specific antigen binding molecules can be isolated from inside or outside (such as medium) of the host cell and purified as substantially pure and homogenous, non-aggregated multi-specific antigen binding molecules (e.g., heterodimeric bispecific antigen binding molecules). As appropriate or desired, the cell or population of cells are cultured in a culture volume of at least 2 L, e.g., at least 5 L, 10 L, 50 L, 100 L, 150 L, 200 L, 250 L, or more. Methods for isolation and purification commonly used for antibody purification may be used for the isolation and purification of herein described multi-specific antigen binding molecules, and are not limited to any particular method. The multi-specific antigen binding molecules may be isolated and purified by appropriately selecting and combining, for example, column chromatography, filtration, ultrafiltration, salting out, solvent precipitation, solvent extraction, distillation, immunoprecipitation, SDS-polyacrylamide gel electrophoresis, isoelectric focusing, dialysis, and recrystallization. Chromatography includes, for example, affinity chromatography, ion exchange chromatography, hydrophobic chromatography, gel filtration, reverse-phase chromatography, and adsorption chromatography (Strategies for Protein Purification and Characterization: A Laboratory Course Manual. Ed Daniel R. Marshak et al., Cold Spring Harbor Laboratory Press, 1996). Chromatography can be carried out using liquid phase chromatography such as HPLC and FPLC. Columns used for affinity chromatography include Protein A column and protein G column. Examples of columns using Protein A column include Hyper D, POROS, and Sepharose FF (GE Healthcare Biosciences). The present disclosure also includes multi-specific antigen binding molecules that are highly purified using these purification methods. In various embodiments, the isolating or purifying step comprises Protein A chromatography, and at least 90%, 91%, 92%, 93%, 94%, 95%, 96%, 97%, 98%, 99%, or more, of the multi-specific antigen binding molecules are isolated or purified. In various embodiments, the isolating or purifying step comprises Protein A chromatography, followed by ion exchange chromatography, and at least 95%, 96%, 97%, 98%, 99%, or more, of the multi-specific antigen binding molecules are isolated or purified. In various embodiments, at least 95%, 96%, 97%, 98%, 99%, or more, of the multi-specific antigen binding molecules isolate or purify as non-aggregated soluble heterodimer as determined using size exclusion chromatography (SEC). In some embodiments, the isolated or purified multi-specific antigen binding molecules have increased homogeneity as assessed by analytical ion exchange chromatography, wherein the integrated area of a main peak representing an unmodified target species is at least 95%, 96%, 97%, 98%, or more, of the sum of all integrated protein peak areas. In some embodiments, the isolated or purified antigen binding molecules have fewer than 35%, 30%, 25%, 20%, 15%, 10%, 9%, 8%, 7%, or fewer, acidic contaminants.

9. Methods of Treating and Preventing HIV

Provided are methods for treating or preventing an HIV infection or a related disease or disorder in a subject in need thereof (e.g., a human subject), comprising providing to a subject in need thereof an effective amount of one or more of the multi-specific antigen binding molecules (e.g., bispecific antigen binding molecules, bispecific antibodies) described herein, or one or more polynucleotides encoding the multi-specific antigen binding molecules.

In some embodiments, the methods entail administering a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO:746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO:746. In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence of SEQ ID NO:746.

The term "treatment" or "treating," to the extent it relates to a disease or condition, includes one or more of preventing the disease or condition from occurring, inhibiting the disease or condition, eliminating the disease or condition, and relieving one or more symptoms of the disease or condition. The terms "treating" and "treatment" as used herein are intended to mean the administration of a compound or composition according to the embodiments disclosed herein to at least one of alleviate or eliminate symptoms of HIV infection and to reduce viral load in a patient. As used herein, the term "effective amount" in the context of the administration of a therapy to a subject refers to the amount of a therapy that achieves a desired prophylactic or therapeutic effect. In various embodiments, the polynucleotide or polynucleotides may be present in a lipid nanoparticle (LNP) or a vector, e.g., a plasmid vector or a viral vector. In some embodiments, the related disease or disorder is caused by infection with HIV. In other embodiments, it is acquired immune deficiency syndrome (AIDS). In certain embodiments, the subject is a virologically suppressed HIV-infected mammal, while in other embodiments, the subject is a treatment-naïve HIV-infected mammal. In certain embodiments, a treatment-naïve subject has a viral load between $10^3$ and $10^5$ copies/ml, and in certain embodiments, a virologically suppressed subject has a viral load of copies/ml in blood of less than 500, e.g., less than 400, less than 300, less than 200, less than 100, less than 50. In another embodiment, the subject is a mammal, e.g., a human. In certain embodiments, the subject has been diagnosed with an HIV, e.g., HIV-1 or HIV-2, infection or a related disease or disorder, e.g., AIDS, or is considered at risk for developing an HIV, e.g., HIV-1 or HIV-2, infection or a related disease or disorder, e.g., AIDS. Subjects at risk for HIV-related diseases or disorders include patients who have come into contact with an infected person or who have been exposed to HIV in some other way. Administration of a prophylactic agent can occur prior to the manifestation of symptoms characteristic of HIV-related disease or disorder, such that a disease or disorder is prevented or, alternatively, delayed in its progression.

Also provided are methods for preventing or inhibiting an increase in HIV virus titer, virus replication, virus proliferation or an amount of an HIV viral DNA, HIV proviral DNA, or HIV viral protein in a subject (e.g., a human subject). In one embodiment, the method comprises providing to the subject in need thereof an amount of one or more multi-specific antigen binding molecules described herein, or one or more polynucleotides encoding the one or more multi-specific antigen binding molecules (or their antigen binding fragments), effective to prevent, reduce or inhibit an increase in HIV titer, virus replication, virus proliferation, or an amount of an HIV protein of one or more HIV strains or isolates in the subject. In certain embodiments, the method further comprises measuring an amount of HIV viral or proviral DNA or protein at one or more time points, e.g., before and after the subject in provided with an antibody or antibodies of the present disclosure. Methods and biomarkers for determining an amount of HIV viral or proviral DNA or protein in a subject are known and available in the art, and described for example, in Siliciano, J. D. et al., Curr Opin. HIV AIDS, 5(6): 491-7 (2010), and Rouzioux, C. et al., Curr Opin HIV AIDS, 8(3):170-5 (2013). In various embodiments, the human subject is an adult, a juvenile or an infant. The subject may be symptomatic (e.g., viremic) or asymptomatic (e.g., acutely infected or ART suppressed). In some embodiments, the human subject is acutely infected or recently infected with HIV. In certain embodiments, the subject has not seroconverted. In some embodiments, the human subject is chronically infected with HIV. The subject many or may not be receiving a regimen of antiretroviral therapy (ART).

Patients can be categorized into Fiebig stages I-VI, which are based on a sequential gain in positive HIV-1 clinical diagnostic assays (viral RNA measured by PCR, p24 and p31 viral antigens measured by enzyme-linked immunosorbent assay (ELISA). p24 antigen is a viral core protein that transiently appears in the blood during the ramp-up phase once HIV-1 RNA levels rise above 10,000 copies/mL and before the development of detectable HIV antibodies. In Fiebig stage I, during ramp-up viremia, only HIV-1 RNA in the blood can be detected. Fiebig stage II commences about 7 days later, when results of tests to detect p24 antigen become positive. In Fiebig stage III, within about 5 days after p24 antigen test results become positive, IgM anti-HIV-1 antibodies can be detected with sufficiently sensitive enzyme immunoassays (EIAs) (e.g., third-generation EIAs). Stage III typically occurs 1-2 weeks after the onset of acute retroviral symptoms. Fiebig stage IV represents the development of an indeterminate Western blot test and occurs about 3 days after EIA tests show positive results. Conversion to a clearly positive Western blot test, Fiebig stage V, generally occurs after another 7 days, or about 1 month after initial infection. Fiebig stages of HIV infection are described, e.g., in Fiebig, et al., AIDS. (2003) 17(13):1871-9; Cohen, et al., *J Infect Dis.* (2010) 202 Suppl 2:S270-7; and McMichael, et al., *Nature Reviews Immunology* (2010) 10:11-23, which are hereby incorporated herein by reference in their entireties for all purposes. In some embodiments, the one or more multi-specific antigen binding molecules described herein, or one or more polynucleotides encoding the one or more multi-specific antigen binding molecules (or their antigen binding fragments), is administered to a human subject having an HIV infection of Fiebig stage IV or earlier, e.g., Fiebig stage I, Fiebig stage II, Fiebig stage III or Fiebig stage IV. In some embodiments, the biological sample evaluated is from a human subject having an HIV infection of an HIV infection of Fiebig stage V or Fiebig stage VI.

In some embodiments, the multi-specific antigen binding molecules comprise a second binding domain, or are co-administered with an antibody or antigen-binding fragment thereof, comprising second VH and VL regions that compete with or comprise VH and VL regions that bind to the third variable loop (V3) (e.g., high mannose patch) comprising a N332 oligomannose glycan and may be used in, for example, methods of inhibiting certain viruses such as HIV isolates described herein, prophylactic inhibiting or preventing infections of certain viruses such as HIV isolates described herein, detection of certain viruses such as HIV isolates described herein in a sample, inhibiting certain viruses such as HIV isolates described herein, or diagnosis of certain viruses such as HIV isolates described herein. Accordingly, in some embodiments, the methods comprise: a) Identifying a human subject who is infected with an HIV expressing a gp120 comprising the following amino acid residues: a glycosylated asparagine at the position corresponding to amino acid residue position 332 (N332glycan), an aspartate at the position corresponding to amino acid residue position 325 (D325), and one or more amino acid residues selected from the group consisting of: a threonine at the position corresponding to amino acid residue position 63 (T63), a leucine at the position corresponding to amino acid residue position 179 (L179), a threonine at the position corresponding to amino acid residue position 320 (T320), and a histidine at the position corresponding to amino acid residue position 330 (H330), wherein the amino acid positions are with reference to SEQ ID NO: 69 (i.e., residues 1-511 of NCBI Ref Seq No. NP_057856.1); and b) Administering to the subject an effective amount of one or more multi-specific antigen binding molecules, a polynucleotide or polynucleotides encoding one or more multi-specific antigen binding molecules, or LNPs or pharmaceutical compositions comprising one or more multi-specific antigen binding molecules or polynucleotide or polynucleotides encoding one or more multi-specific antigen binding molecules, as described above and herein, wherein the second binding domain of at least one multi-specific antigen binding molecule competes with or comprises second VH and VL regions that bind to the third variable loop (V3) (e.g., high mannose patch) comprising a N332 oligomannose glycan. In some embodiments, the method entails identifying a subject infected with an HIV or a population of HIV expressing a gp120 comprising the following amino acid residues: i. N332glycan, D325 and T63; ii. N332glycan, D325 and L179; iii. N332glycan, D325 and T320; iv. N332glycan, D325 and H330; v. N332glycan, D325, T63 and L179; vi. N332glycan, D325, T63 and T320; vii. N332glycan, D325, T63 and H330; viii. N332glycan, D325, L179 and T320; ix. N332glycan, D325, L179 and H330; x. N332glycan, D325, T320 and H330; xi. N332glycan, D325, T63, T320 and H330; xii. N332glycan, D325, T63, L179 and T320; xiii. N332glycan, D325, T63, L179 and H330; xiv. N332glycan, D325, L179, T320 and H330; or xv. N332glycan, D325, T63, L179, T320 and H330, wherein the amino acid positions are with reference to SEQ ID NO: 69. In some embodiments, the method entails identifying a subject infected with an HIV or a population of HIV expressing a gp120 comprising the following amino acid residues: i. N332glycan, D325 and T63; ii. N332glycan, D325 and L179; iii. N332glycan, D325 and T320; or iv. N332glycan, D325 and H330, wherein the amino acid positions are with reference to SEQ ID NO: 69. In some embodiments, the method entails identifying a subject infected with an HIV or a population of HIV expressing a gp120 comprising the following amino acid residues: i. N332glycan, D325, T63 and L179; ii. N332glycan, D325, T63 and T320; iii. N332glycan, D325, T63 and H330; iv. N332glycan, D325, L179 and T320; v. N332glycan, D325, L179 and H330; or vi. N332glycan, D325, T320 and H330, wherein the amino acid positions are with reference to SEQ ID NO: 69. In some embodiments, the method entails identifying a subject infected with an HIV or a population of HIV expressing a gp120 comprising the following amino acid residues: i. N332glycan, D325, L179, T320 and H330; ii. N332glycan, D325, T63, T320 and H330; iii. N332glycan, D325, T63, L179 and T320; or iv. N332glycan, D325, T63, L179 and H330, wherein the amino acid positions are with reference to SEQ ID NO: 69. In some embodiments, the method entails identifying a subject infected with an HIV or a population of HIV expressing a gp120 comprising at least one of the following amino acid residues: i. N332glycan, D325, T63 and H330; ii. N332glycan, D325, T320 and H330; iii. N332glycan, D325, L179, T320 and H330; or iv. N332glycan, D325, T63, L179, T320 and H330, wherein the amino acid positions are with reference to SEQ ID NO: 69. In some embodiments, the subject is infected with an HIV or a population of HIV expressing a gp120 further comprising one or more of the following amino acid residues: a glycan at amino acid residue 301 (glycan301); a lysine at amino acid residue 677 (K677); an amino acid residue other than tryptophan (e.g., A, C, D, E, F, G, H, I, K, L, M, N, P, Q, R, S, T, V or Y) at position 17 (not_W17); an amino acid residue other than arginine (e.g., A, C, D, E, F, G, H, I, K, L, M, N, P, Q, S, T, V, W or Y) at position 747 (not R747); an insertion 321.01 (e.g., an insertion of any amino acid (e.g., A, C, D, E, F, G, H, I, K, L, M, N, P, Q, R, S, T, V, W or Y) between position G321 and K322); a glutamic acid at position 429 (E429); a glutamine at position 442 (Q442); an arginine at position 335 (R335); an isoleucine at position 165 (I165); a serine at position 393 (S393); an isoleucine at position 307 (I307); a glycan at position 295 (295 glycan); and an asparagine at position 300 (N300), wherein the amino acid positions are with reference to SEQ ID NO: 69. In some embodiments, the second antigen binding domain competes with or comprises second VH and VL regions from an antibody selected from the group consisting of GS-9722 (elipovimab), GS-9721, GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the second antigen binding domain competes with or comprises second VH and VL regions from an antibody selected from the group consisting of GS-9722 (elipovimab), GS-9721, GS-2872, PGT-121.66, PGT-121, PGT-121.414, 10-1074, 10-1074-J and PGT-134. See, co-owned and co-pending Intl. Appl. No. PCT/US2020/033470, entitled "METHODS OF IDENTIFYING HIV PATIENTS SENSITIVE TO THERAPY WITH GP120 V3 GLYCAN-DIRECTED ANTIBODIES," published as WO 2020/236753, which is hereby incorporated herein by reference in its entirety for all purposes.

In some embodiments, the multi-specific antigen binding molecules comprise a second binding domain, or are co-administered with an antibody or antigen-binding fragment thereof, comprising second VH and VL regions that compete with or comprise VH and VL regions that bind to the CD4 binding site (CD4bs) and may be used in, for example, methods of inhibiting certain viruses such as HIV isolates described herein, prophylactic inhibiting or preventing infections of certain viruses such as HIV isolates described herein, detection of certain viruses such as HIV isolates described herein in a sample, inhibiting certain viruses such as HIV isolates described herein, or diagnosis of certain viruses such as HIV isolates described herein. Accordingly, in some embodiments, the methods entail (a) Identifying a human subject who is infected with an HIV or a population of HIV expressing a gp120 comprising the following amino acid residues: I201 and one or more of the amino acid residues selected from the group consisting of E102, I108, A281, Y318 and F353, wherein the amino acid positions are with reference to SEQ ID NO: 73; and (b) Administering to the subject an effective amount of an antibody or antigen-binding fragment thereof that competes with or comprises VH and VL regions that bind to an epitope of gp120 comprising the CD4 binding site (CD4bs). In some embodiments, the methods entail identifying a subject infected with an HIV or a population of HIV expressing a gp120 comprising the following amino acid residues: I201 and F353; I201, I108 and F353; I201, I108, A281 and F353; I201, E102, I108, A281 and F353; or I201, E102, I108, A281, Y318 and F353. In some embodiments, the methods entail identifying a subject infected with an HIV or a population of HIV expressing a gp120 comprising the following amino acid residues: I201, I108 and F353; I201, I108, A281 and F353; I201, E102, I108, A281 and F353; or I201, E102, I108, A281, Y318 and F353. In some embodiments, the methods entail identifying a subject infected with an HIV or a population of HIV expressing a gp120 comprising the following amino acid residues: I201, I108, A281 and F353; I201, E102, I108, A281 and F353; or I201, E102, I108, A281, Y318 and F353. In some embodiments, the administered antibody or antigen-binding fragment thereof competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the administered antibody or antigen-binding fragment thereof competes with or comprises VH and VL regions from an antibody selected from the group consisting of 3BNC117, GS-9723, GS-5423, 3BNC60, VRC01, VRC07 and VRC07-523. See, co-owned and co-pending Provisional Appl. No. 63/112,512, entitled "METHODS OF IDENTIFYING HIV PATIENTS SENSITIVE TO THERAPY WITH gp120 CD4 BINDING SITE-DIRECTED ANTIBODIES," which is hereby incorporated herein by reference in its entirety for all purposes.

For in vivo treatment of mammalian subject, e.g., humans, the subject may be administered or provided a pharmaceutical composition comprising one or more multi-specific antigen binding molecules, described herein, and optionally an additional anti-HIV therapeutic agent (e.g., an anti-HIV a broadly neutralizing antibody (bNAb), a TLR agonist). When used for in vivo therapy, an antibody or antibodies described herein are typically administered or provided to the patient in therapeutically effective amounts (i.e., amounts that eliminate or reduce at least one of the patient's viral burden and viral reservoir). In some embodiments, a multi-specific antigen binding molecule is administered at a dose in the range of 0.05 mg to 1000 mg per administration, e.g., from 0.05 mg to 150 mg per administration, e.g., from 0.05 mg to 0.35 mg per administration, e.g., from 25 mg to 50 mg per administration, e.g., from 30 mg to 35 mg per administration, e.g., from 10 mg to 1000 mg per administration, e.g., from 50 mg to 1000 mg per administration, e.g., from 100 mg to 700 mg per administration, e.g., at least 0.05 mg up to 0.1 mg, 0.2 mg, 0.3 mg, 0.35 mg, 0.4 mg, 0.5 mg, 0.6 mg, 0.7 mg, 0.8 mg, 1.0 mg, 5 mg, 10 mg, 25 mg, 30 mg, 35 mg, 40 mg, 45 mg, 50 mg, 60 mg, 70 mg, 80 mg, 90 mg, 100 mg, 200 mg, 300 mg, 400 mg, 500 mg, 600 mg, 700 mg, 800 mg, 900 mg, or 1000 mg per administration. In some embodiments, a multi-specific antigen binding molecule is administered at a dose of from 1 µg/kg to 50 mg/kg body weight per administration, e.g., from 1 µg/kg to 5 µg/kg, e.g., from 350 µg/kg to 550 µg/kg, e.g., from 0.3 mg/kg to 30 mg/kg, e.g., from 2 mg/kg to 10 mg/kg, e.g., from 1 µg/kg up to 2 µg/kg, 3 µg/kg, 4 µg/kg, 5 µg/kg, 10 µg/kg, 50 µg/kg, 100 µg/kg, 250 µg/kg, 300 µg/kg, 350 µg/kg, 400 µg/kg, 410 µg/kg, 420 µg/kg, 430 µg/kg, 440 µg/kg, 450 µg/kg, 460 µg/kg, 470 µg/kg, 480 µg/kg, 490 µg/kg, 500 µg/kg, 750 µg/kg, 1 mg/kg, 1.5 mg/kg, 2 mg/kg, 2.5 mg/kg, 3 mg/kg, 3.5 mg/kg, 4 mg/kg, 4.5 mg/kg, 5 mg/kg, 6 mg/kg, 7 mg/kg, 8 mg/kg, 9 mg/kg, 10 mg/kg, 15 mg/kg, 20 mg/kg, 25 mg/kg, 30 mg/kg, 35 mg/kg, 40 mg/kg, 45 mg/kg, or 50 mg/kg, body weight per administration. In some embodiments, dosing of a multi-specific antigen binding molecule can be reduced or decreased when combining with a second therapeutic agent, e.g., at least one of a second antigen binding molecule and a TLR agonist.

In particular embodiments, a multi-specific antigen binding molecule, described herein, may be provided to a subject in an amount sufficient to achieve a $C_{trough}$ level of ≤0.1 µg/mL, ≤0.5 µg/ml, ≤1 µg/ml, ≤10 µg/ml, ≤20 µg/ml, ≤25

µg/ml, ≤30 µg/ml, ≤40 µg/ml, ≤50 µg/ml, ≤75 µg/ml, ≤100 µg/ml, e.g., with a dosing regimen in the range of 2-10 mg/kg at 2 week intervals (Q2W). In certain embodiments, a multi-specific antigen binding molecule, described herein, may be provided to a subject in an amount sufficient to achieve a $C_{trough}$ level in the range of 0.0025 µg/ml to 100 µg/ml, e.g., 0.1 µg/ml to 100 µg/ml, e.g., 0.1 µg/ml to 25 µg/ml. In particular embodiments, a multi-specific antigen binding molecule, described herein, may be provided to a subject in an amount sufficient to achieve a $C_{max}$ level in the range of 0.25 µg/ml to 1000 µg/ml, e.g., in the range of 50 µg/ml to 250 µg/ml, e.g., >0.25 µg/ml, >0.5 µg/ml, >0.75 µg/ml, >1 µg/ml, >5 µg/ml, >10 µg/ml, >50 µg/ml, >100 µg/ml, >200 µg/ml, >300 µg/ml, >400 µg/ml, >500 µg/ml, or >1000 µg/mL. In certain embodiments, a multi-specific antigen binding molecule, described herein, may be provided to a subject in an amount sufficient to achieve a $C_{max}$ level of 1 µg/ml to 1000 µg/ml, e.g., in the range of 50 µg/ml to 250 µg/ml, e.g., with a dosing regimen in the range of 2-10 mg/kg at 2 week intervals (Q2W). Administration of lower doses and/or repeat dosing at less frequent intervals will result in lower $C_{trough}$ levels and lower $C_{max}$ levels. Administration of higher doses and/or repeat dosing at more frequent intervals will result in higher $C_{trough}$ levels and higher $C_{max}$ levels.

In various embodiments, the multi-specific antigen binding molecule has a serum half-life in a human or cynomolgus monkey of at least 3 days, e.g., at least 4 days, at least 5 days, at least 6 days, at least 7 days, at least 8 days, at least 9 days, at least 10 days, at least 11 days, at least 12 days, at least 13 days, at least 14 days, at least 15 days, at least 16 days, or longer. In various embodiments, the multi-specific antigen binding molecule has a serum half-life in a human or cynomolgus monkey of at least at least 5 days, e.g., at least 5.5 days, at least 6 days, at 6.5 days, at least 7 days, at least 7.5 days, at least 8 days, at least 8.5 days, at least 9 days, at least 10 days, at least 11 days, at least 12 days, at least 13 days, at least 14 days, at least 15 days, at least 16 days, or longer. In some embodiments, the multi-specific antigen binding molecule has a serum half-life in a human or cynomolgus monkey of at least 7 days. In various embodiments, the multi-specific antigen binding molecule has a first antigen binding domain that binds to CD3 with a $K_D$ of lower than 10 nM, e.g., lower than 5.0 nM, 4.5 nM, 4.0 nM, 3.5 nM, 3.0 nM, or lower and antigen binding molecule has a serum half-life in a human or cynomolgus monkey of at least at least 5 days, e.g., at least 5.5 days, at least 6 days, at least 6.5 days, at least 7 days, at least 7.5 days, at least 8 days, at least 8.5 days, at least 9 days, at least 10 days, at least 11 days, at least 12 days, at least 13 days, at least 14 days, at least 15 days, at least 16 days, or longer. In some embodiments, the multi-specific antigen binding molecule has a first antigen binding domain that binds to CD3 with a $K_D$ of lower than 3.0 nM (e.g., 2.5 nM) and antigen binding molecule has a serum half-life in a human or cynomolgus monkey of at least 7 days.

In various embodiments, the one or more multi-specific antigen binding molecules described herein are administered one or multiple times. In embodiments employing multiple administration regimens, as appropriate the one or more multi-specific antigen binding molecules described herein can be administered in once daily, once weekly (i.e., QW), once bi-weekly (i.e. once every other week, or once every two weeks or Q2W), once monthly (i.e., QM) or once bi-monthly dosing (i.e. once every other month, or once every two months or Q2M) dosing or administration intervals. In some embodiments, the one or more multi-specific antigen binding molecules are administered once daily, once weekly (i.e., QW), once bi-weekly (i.e. once every other week, or once every two weeks or Q2W), once monthly (i.e., QM), once bi-monthly (i.e. once every other month, or once every two months or Q2M), once every three months (i.e., Q3M), once every four months (i.e., Q4M), once every 5 months (i.e., Q5M), or once every 6 months (i.e., Q6M) dosing. In some embodiments, the one or more multi-specific antigen binding molecules are administered intravenously, subcutaneously or intramuscularly bi-weekly (i.e. once every other week, or once every two weeks or Q2W). In some embodiments, the one or more multi-specific antigen binding molecules are administered intravenously, subcutaneously or intramuscularly monthly (e.g., once every four weeks (Q4W) or once monthly (Q1M)). As appropriate, doses administered in multiple administration regimens can be the same or different between the first and subsequent doses of a first multi-specific antigen binding molecule. As appropriate, doses administered in multiple administration regimens can be the same or different between a first multi-specific antigen binding molecule and a second therapeutic agent (e.g., a second antigen binding molecule or an anti-HIV broadly neutralizing antibody (bNAb)).

The one or more multi-specific antigen binding molecules described herein are administered or provided to a mammalian subject, e.g., a human, in accord with known methods, such as, but not limited to, intravenous administration, e.g., as a bolus or by continuous infusion over a period of time, by intramuscular, subcutaneous, intraperitoneal, intracerebrospinal, intraarticular, intrasynovial, intrathecal, oral, topical, or inhalation routes. As appropriate, the multi-specific antigen binding molecules may be administered parenterally, when possible, at the target cell site, or intravenously. In one embodiment, administration of the one or more multi-specific antigen binding molecules to the subject is via an intravenous route. In another embodiment, administration of the one or more multi-specific antigen binding molecules to the subject is via a subcutaneous route. In another embodiment, administration of the one or more multi-specific antigen binding molecules to the subject is via an intramuscular route. In various embodiments, polynucleotides encoding the multi-specific antigen binding molecules can be electroporated, e.g., for transdermal delivery. In some embodiments, pharmaceutical compositions of the disclosure are administered to a subject systemically, parenterally, or locally.

Further provided are methods for treating an HIV infection, comprising administering to a human subject in need thereof a therapeutically effective amount of one or more multi-specific antigen binding molecules, as disclosed herein. In some embodiments, the present disclosure provides a method for preventing an HIV infection, comprising administering to a human subject in need thereof a therapeutically effective amount of one or more multi-specific antigen binding molecules, as disclosed herein.

In one embodiment, a method for treating an HIV infection in a human subject having or at risk of having the infection is provided, the method comprising administering to the human subject a therapeutically effective amount of one or more multi-specific antigen binding molecules disclosed herein, optionally in combination with a therapeutically effective amount of one or more (e.g., one, two, three, one or two, or one to three) additional therapeutic agents. In some embodiments, after one or more administrations of the one or more multi-specific antigen binding molecules described herein, optionally with one or more additional therapeutic agents, the subject does not exhibit symptoms of HIV or AIDS in the absence of anti-retroviral treatment (ART) for at least 6 months, at least 1 year, at least 2 years, at least 3 years, or more. In some embodiments, after one or more administrations of the one or more multi-specific antigen binding molecules, optionally with one or more additional therapeutic agents, the subject has a viral load of copies/ml blood of less than 500, e.g., less than 400, less than 300, less than 200, less than 100, less than 50, in the absence of anti-retroviral treatment (ART) for at least 6 months, at least 1 year, at least 2 years, at least 3 years, or more.

10. Combination Therapies

In certain embodiments, this disclosure provides a method for treating or preventing an HIV infection in a human subject having, or at risk of having, the HIV infection. The method comprises administering to the human subject a therapeutically effective amount of one or more multi-specific antigen binding molecules, as disclosed herein, or a pharmaceutical composition thereof, in combination with a therapeutically effective amount of one or more (e.g., one, two, three, one or two, or one to three) additional therapeutic agents. In one embodiment, a method for treating an HIV infection in a human subject having or at risk of having the infection is provided, the method comprising administering to the human subject a therapeutically effective amount of one or more multi-specific antigen binding molecule, or a pharmaceutically acceptable salt thereof, in combination with a therapeutically effective amount of one or more (e.g., one, two, three, one or two, or one to three) additional therapeutic agents.

In one embodiment, pharmaceutical compositions comprising one or more of the multi-specific antigen binding molecules disclosed herein, or a pharmaceutical composition thereof, in combination with one or more (e.g., one, two, three, one or two, or one to three) additional therapeutic agents, and a pharmaceutically acceptable carrier, diluent, or excipient are provided.

In certain embodiments, provided are methods for treating an HIV infection, comprising administering to a patient in need thereof a therapeutically effective amount of one or more of the multi-specific antigen binding molecules described herein, or a pharmaceutical composition thereof, in combination with a therapeutically effective amount of one or more additional therapeutic agents which are suitable for treating an HIV infection.

In certain embodiments, one or more of the multi-specific antigen binding molecules described herein, or a pharmaceutical composition thereof, are combined or co-administered with one, two, three, four, or more additional therapeutic agents. In certain embodiments, one or more of the multi-specific antigen binding molecules described herein, or a pharmaceutical composition thereof, are combined or co-administered with two additional therapeutic agents. In other embodiments, one or more of the multi-specific antigen binding molecules described herein, or a pharmaceutical composition thereof, are combined or co-administered with three additional therapeutic agents. In further embodiments, one or more of the multi-specific antigen binding molecules described herein, or a pharmaceutical composition thereof, is combined or co-administered with four additional therapeutic agents. The one, two, three, four, or more additional therapeutic agents can be different therapeutic agents selected from the same class of therapeutic agents (e.g., one or more anti-HIV broadly neutralizing antibodies), and/or they can be selected from different classes of therapeutic agents (e.g., one or more anti-HIV broadly neutralizing antibodies and one or more TLR agonists).

Administration of HIV Combination Therapies

In certain embodiments, one or more of the multi-specific antigen binding molecules described herein are co-administered with one or more additional therapeutic agents. Co-administration of one or more multi-specific antigen binding molecules disclosed herein with one or more additional therapeutic agents generally refers to simultaneous or sequential administration of one or more multi-specific antigen binding molecules disclosed herein and one or more additional therapeutic agents, such that therapeutically effective amounts of the one or more multi-specific antigen binding molecules disclosed herein and the one or more additional therapeutic agents are both present in the body of the patient. When administered sequentially, the combination may be administered in two or more administrations.

Co-administration includes concurrent administration as well as sequential administration of unit dosages of the one or more of the multi-specific antigen binding molecules described herein before or after administration of unit dosages of one or more additional therapeutic agents. For example, one or more of the multi-specific antigen binding molecules described herein may be administered within seconds, minutes, hours or days of the administration of the one or more additional therapeutic agents. In some embodiments, a unit dose of one or more multi-specific antigen binding molecules disclosed herein is administered first, followed within seconds, minutes, hours or days by administration of a unit dose of one or more additional therapeutic agents. Alternatively, a unit dose of one or more additional therapeutic agents is administered first, followed by administration of a unit dose of one or more multi-specific antigen binding molecules disclosed herein within seconds, minutes, hours or days. In other embodiments, a unit dose of one or more multi-specific antigen binding molecules disclosed herein is administered first, followed, after a period of hours (e.g., 1-12 hours, 1-24 hours, 1-36 hours, 1-48 hours, 1-60 hours, 1-72 hours), by administration of a unit dose of one or more additional therapeutic agents. In yet other embodiments, a unit dose of one or more additional therapeutic agents is administered first, followed, after a period of hours (e.g., 1-12 hours, 1-24 hours, 1-36 hours, 1-48 hours, 1-60 hours, 1-72 hours), by administration of a unit dose of one or more multi-specific antigen binding molecules disclosed herein.

In certain embodiments, one or more multi-specific antigen binding molecules disclosed herein is combined or co-administered with one or more additional therapeutic agents in a unitary dosage form for simultaneous administration to a patient, for example as a liquid or suspension dosage form, e.g., for intravenous, intramuscular or subcutaneous administration.

In certain embodiments, the one or more multi-specific antigen binding molecules are formulated as a liquid solution or suspension which may optionally contain one or more other additional therapeutic agents useful for treating HIV. In certain embodiments, the liquid solution or suspension can contain another active ingredient for treating HIV, as another anti-HIV antibody or antigen-binding fragment thereof, a HIV protease inhibitor, a HIV non-nucleoside or non-nucleotide inhibitor of reverse transcriptase, a HIV nucleoside or nucleotide inhibitor of reverse transcriptase, a HIV integrase inhibitor, a HIV non-catalytic site (or allosteric) integrase inhibitor, pharmacokinetic enhancer, and combinations thereof.

In certain embodiments, the one or more multi-specific antigen binding molecules can be administered in multiple administration regimens, i.e., are administered two or more times at first and subsequent time points. In certain embodiments, such liquid solutions or suspensions are suitable for once daily, once weekly (i.e., QW), once bi-weekly (i.e. once every other week, or once every two weeks or Q2W), once monthly (i.e., QM) or once bi-monthly dosing (i.e. once every other month, or once every two months or Q2M) dosing or administration intervals. In some embodiments, the one or more multi-specific antigen binding molecules are administered once daily, once weekly (i.e., QW), once bi-weekly (i.e. once every other week, or once every two weeks or Q2W), once monthly (i.e., QM), once bi-monthly (i.e. once every other month, or once every two months or Q2M), once every three months (i.e., Q3M), once every four months (i.e., Q4M), once every 5 months (i.e., Q5M), or once every 6 months (i.e., Q6M) dosing. In some embodiments, the one or more multi-specific antigen binding molecules are administered intravenously, subcutaneously or intramuscularly bi-weekly (i.e. once every other week, or once every two weeks or Q2W). In some embodiments, the one or more multi-specific antigen binding molecules are administered intravenously, subcutaneously or intramuscularly monthly (e.g., once every four weeks (Q4W) or once monthly (Q1M)).

a. Combination Therapies with One or More Additional Broadly Neutralizing Antibodies In certain embodiments, a multi-specific antigen binding molecule disclosed herein is combined or co-administered with one or more additional anti-HIV broadly neutralizing antibodies (bNAbs), or fragments thereof. The one or more additional bNAbs can be in any format (e.g., monospecific, multi-specific, IgG, scFv). Generally, the one or more additional bNAbs bind to a different antigen, or region or epitope of HIV that does not compete with the first multi-specific antigen binding molecule. Multiple clinical studies have now shown that treatment of HIV infected individuals with single broadly neutralizing antibodies (bNAbs) leads to temporary suppression of sensitive viruses, followed by rapid outgrowth of resistant viruses—many of which appear to be rare pre-existing viral variants.

Scheid, et al. reported that VRC01 (a V3-glycan binding bNAb) and 3BNC117 (a CD4 binding site binding bNAb) neutralized 96% of 118 cross-clade viruses tested in-vitro (Scheid et al., Science, 333: 1633-1637 (2011)). Further, clinical trials showed that many HIV infected patients receiving the antibody treatment exhibited rare and pre-existing resistant clones, even when their plasma HIV isolates appeared to be sensitive to the antibody (Caskey et al., Nature, 522: 487-491 (2016); Scheid et al., Nature, 535: 556-560 (2016)). These results suggested that 3BNC117 may be broad when tested against HIV isolates collected from different patients (inter-patient bread), yet it may not neutralize 100% of viral isolates within individual patients (intra-patient breadth).

An antibody known as 10-1074, part of the PGT121 lineage and taken from the same donor and with similar neutralizing breadth, has also been tested in clinical trials (Mouquet et al., PNAS, 109:E3268-3277 (2012); Caskey et al., Nature Medicine, 23:185-191 (2017)). 10-1074 was originally shown to neutralize approximately 66% of 60 viruses tested at an IC50 below 50 µg/mL (Mouquet et al., PNAS (supra)). The 10-1074 trials showed that in many patients received 10-1074 therapy, there were resistant clones, even when the plasma HIV isolates appeared to be sensitive to the antibody (Caskey et al. Nature Medicine (supra)). This data suggests that most patients may harbor rare pre-existing viral variants that are resistant to 10-1074. These 10-1074 resistance variants showed correlated cross-resistance to PGT121, consistent with close evolutionary relationship between 10-1074 and PGT121. However, nearly all of the resistant viruses isolated during the 10-1074 clinical trial were sensitive to neutralization by 3BNC117 (Caskey et al. Nature Medicine (supra)). This data is consistent with the conclusion that combination antibody therapy, using complementary bNAbs that bind to different regions of gp120, allows for more complete intra-patient viral coverage.

In certain embodiments, the bNAb combinations can achieve complete intra-patient viral coverage. In some embodiments, the combination therapy includes first and second antigen binding molecules, wherein the first and second antigen binding molecules bind to different first and second epitopes or regions of gp120, or gp120 and gp41. In some embodiments, the combination therapy includes a multi-specific antigen binding molecule and an anti-HIV broadly neutralizing antibody (bNAb), wherein the multi-specific antigen binding molecule and the bNAb bind to different first and second epitopes or regions of gp120, or gp120 and gp41. In some embodiments, the different first and second epitopes or regions of gp120 are selected from the group consisting of: (i) third variable loop (V3) (e.g., high mannose patch) comprising a N332 oligomannose glycan; (ii) second variable loop (V2) (e.g., Env trimer apex); (iii) CD4 binding site (CD4bs); (iv) gp120/gp41 interface; or (v) silent face of gp120. In some embodiments, the combination therapy includes a first multi-specific antigen binding molecule, described herein, and another anti-HIV broadly neutralizing antibody or bNAb (i.e., a neutralizing antibody that neutralizes multiple HIV-1 viral strains). Various bNAbs are known in the art and may be used as one or both of a combining therapeutic agent and in the anti-HIV antigen targeting arm or second antigen binding domain of the herein described multi-specific antigen binding molecules, identified herein. Additional illustrative bNAbs of use include, without limitation, those described in U.S. Pat. Nos. 8,673,307; 9,493,549; 9,783,594; and WO 2012/154312; WO2012/158948; WO2013/086533; WO2013/142324; WO2014/063059; WO 2014/089152, WO 2015/048462; WO 2015/103549; WO2015/117008; WO2016/014484; WO 2016/154003; WO 2016/196975; WO2016/149710; WO2017/096221; WO 2017/133639; WO 2017/133640, WO 2018/125813, including antibodies 12A12, 12A21, NIH45-46, bANC131, 8ANC134, IB2530, INC9, 8ANC195, 8ANC196, 10-259, 10-303, 10-410, 10-847, 10-996, 10-1074, 10-1121, 10-1130, 10-1146, 10-1341, 10-1369, 10-1074GM and BG18. Additional examples include those described in Sajadi, et al., Cell. (2018) 173 (7):1783-1795; Sajadi, et al., J Infect Dis. (2016) 213(1): 156-64; Klein et al., Nature, 492(7427): 118-22 (2012), Horwitz et al., Proc Natl Acad Sci USA, 110(41): 16538-43 (2013), Scheid, et al., Science, 333: 1633-1637 (2011), Scheid, et al., Nature, 458:636-640 (2009), Eroshkin et al, Nucleic Acids Res., 42 (Database issue):D1 133-9 (2014), Mascola et al., Immunol Rev., 254(1):225-44 (2013), such as 2F5, 4E10, M66.6, CAP206-CH12, 10E8, 10E8v4, 10E8-5R-100cF, DH511.11P, 7b2, and LN01 (all of which bind the MPER of gp41); PG9, PG16, CH01-04 (all of which bind V1V2-glycan), 2G12 (which binds to outer domain glycan); b12, F105, VRC01, VRC07, VRC07-523, VRC03, VRC06, VRC06b01 VRC08, VRC0801, NIH45-46, 3BNC117, 3BNC60, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25 (all of which bind to the CD4 binding site).

In some embodiments, the combination therapy includes a multi-specific antigen binding molecule or an antibody that binds to an epitope or region of gp120 in the third variable loop (V3) (e.g., high mannose patch) comprising a N332 oligomannose glycan and competes with or comprises one or more of CDRs and VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the combination therapy includes a multi-specific antigen binding molecule or an antibody that binds to an epitope or region of gp120 in the CD4 binding site (CD4bs) and competes with or comprises one or more of CDRs and VH and VL regions from an antibody selected from the group consisting of b12, F105, VRC01, VRC07, VRC07-523, VRC03, VRC06, VRC06b01 VRC08, VRC0801, NIH45-46, 3BNC117, 3BNC60, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the combination therapy comprises co-administering (i) a multi-specific antigen binding molecule targeting CD3 and comprising a soluble extracellular region of CD4 (e.g., domain 1 (D1), D1-D2, D1-D3, D1-D4), as described herein; (ii) an antibody that competes with or comprises VH and VL regions from an antibody selected from the group consisting of 10-1074, 10-1074-J, GS-9722 (elipovimab), GS-2872, PGT-121, PGT-121.66, PGT-121.414 and PGT-134; and; (iii) an antibody that competes with or comprises VH and VL regions from an antibody selected from the group consisting of GS-9723, GS-5423, 3BNC117, VRC07 and VRC07-523.

In some embodiments, the combination therapy includes a multi-specific antigen binding molecule or an antibody that binds to an epitope or region of gp120 in the second variable loop (V2) (e.g., Env trimer apex) and competes with or comprises one or more of CDRs and VH and VL regions from an antibody selected from the group consisting of PG9, PG16, PGC14, PGG14, PGT-142, PGT-143, PGT-144, PGT-145, CH01, CH59, PGDM1400, CAP256, CAP256-VRC26.08, CAP256-VRC26.09, CAP256-VRC26.25, PCT64-24E and VRC38.01. In some embodiments, the combination therapy includes a multi-specific antigen binding molecule or an antibody that binds to an epitope or region of gp120 in the gp120/gp41 interface and competes with or comprises second VH and VL regions from an antibody selected from the group consisting of PGT-151, CAP248-2B, 35O22, 8ANC195, ACS202, VRC34 and VRC34.01. In some embodiments, the combination therapy includes a multi-specific antigen binding molecule or an antibody that binds to an epitope or region of the gp120 silent face and competes with or comprises second VH and VL regions from an antibody selected from VRC-PG05 and SF12. In some embodiments, the combination therapy includes a multi-specific antigen binding molecule or an antibody that binds to an epitope or region of gp41 in the membrane proximal region (MPER) and competes with or comprises second VH and VL regions from an antibody selected from the group consisting of 10E8, 10E8v4, 10E8-5R-100cF, 4E10, DH511.11P, 2F5, 7b2, and LN01. In some embodiments, the combination therapy includes a multi-specific antigen binding molecule or an antibody that binds to and epitope or region of the gp41 fusion peptide and competes with or comprises second VH and VL regions from an antibody selected from the group consisting of VRC34 and ACS202.

In certain embodiments, the multi-specific antigen binding molecules and/or bNAbs may be improved to have enhanced drug-like-properties, reduced immunogenicity, enhanced ADCC, and suitable pharmacokinetic properties. Such antibodies were shown to bind to the HIV envelope glycoprotein expressed on the surface of virion or infected cells, and mediating both direct neutralization of the virus as well as potent NK, Monocyte and PBMC killing of these cells. This property allows the antibodies to treat HIV infections by neutralizing the virus, and also kill and eliminate latently HIV infected cells in infected individuals, potentially leading to a sterilizing cure for HIV.

b. Combination Therapies with One or More Additional Anti-HIV Therapeutic Agents HIV Combination Therapy In some embodiments, the additional therapeutic agent is a latency reversing agent (LRA). Example LRAs include IL-15 receptor agonists (e.g., ALT-803; interleukin-15/Fc fusion protein (e.g., XmAb24306)); recombinant interleukin-15 (e.g., AM0015, NIZ-985); pegylated IL-15 (e.g., NKTR-255)) and agonists of a toll-like receptor (TLR), e.g., an agonist of one or more of TLR1 (NCBI Gene ID: 7096), TLR2 (NCBI Gene ID: 7097), TLR3 (NCBI Gene ID: 7098), TLR4 (NCBI Gene ID: 7099), TLR5 (NCBI Gene ID: 7100), TLR6 (NCBI Gene ID: 10333), TLR7 (NCBI Gene ID: 51284), TLR8 (NCBI Gene ID: 51311), TLR9 (NCBI Gene ID: 54106), and TLR10 (NCBI Gene ID: 81793). In some embodiments, the LRA is a TLR7 agonist. In other embodiments, the additional therapeutic agent is a latency reversing agent (LRA), e.g., a TLR8 agonist. Examples of TLR agonists include but are not limited to vesatolimod. Additional examples include but are not limited to the compounds described in U.S. Pat. No. 8,367,670 and the compounds described in U.S. Patent Application Publication No. 2016/0289229. In one embodiment, the antibody described herein may be combined with TLR7 agonist such as vesatolimod. In another embodiment, the antibody described herein may be combined with TLR8 agonist, e.g., selgantolimod (GS-9688). In one embodiment, the additional therapeutic agent is a TLR modulator. TLR modulators may include modulators of TLR1, TLR2, TLR3, TLR4, TLR5, TLR6, TLR7, TLR8, TLR9, TLR10, TLR11, TLR12, and TLR13. Examples of TLR3 modulators include rintatolimod, poly-ICLC, RIBOXXON®, Apoxxim, RIBOXXIM®, IPH-33, MCT-465, MCT-475, and ND-1.1. Examples of TLR7 modulators include GS-9620, GSK-2245035, imiquimod, resiquimod, DSR-6434, DSP-3025, IMO-4200, MCT-465, MEDI-9197, 3M-051, SB-9922, 3M-052, Limtop, TMX-30X, TMX-202, RG-7863, RG-7795, and the compounds disclosed in US20100143301 (Gilead Sciences), US20110098248 (Gilead Sciences), and US20090047249 (Gilead Sciences). Examples of TLR8 modulators include selgantolimod (GS-9688), motolimod, resiquimod, 3M-051, 3M-052, MCT-465, IMO-4200, VTX-763, VTX-1463, and the compounds disclosed in US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). Examples of TLR9 modulators (e.g., agonists) include BB-001, BB-006, CYT-003, IMO-2055, IMO-2125, IMO-3100, IMO-8400, IR-103, IMO-9200, AST-008 (cavrotolimod), cobitolimod, CMP-001, agatolimod, DIMS-9054, DV-1079, DV-1179, AZD-1419, leftolimod (MGN-1703), litenimod, CYT-003-QbG10, tilsotolimod and PUL-042.

In some embodiments, the additional therapeutic agent is an agonist of DExD/H-box helicase 58 (DDX58; a.k.a., RIG-I, RIG1, RIGI, RLR-1, SGMRT2; NCBI Gene ID: 23586). An illustrative RIG-I agonist is KIN1148, described by Hemann, et al., J Immunol May 1, 2016, 196 (1 Supplement) 76.1. Additional RIG-I agonists are described, e.g., in Elion, et al., Cancer Res. (2018) 78(21):6183-6195; and Liu, et al., J Virol. (2016) 90(20):9406-19. RIG-I agonists are commercially available, e.g., from Invivogen (invivogen.com).

In certain embodiments, such formulations are suitable for once daily, once weekly, once bi-weekly, once monthly, once every two months, or once every three months dosing.

In some embodiments, the additional therapeutic agent may be an anti-HIV agent. In some instances, the additional therapeutic agent can be HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, HIV entry inhibitors, HIV maturation inhibitors, HIV capsid inhibitors, nucleocapsid protein 7 (NCp7) inhibitors, HIV Tat or Rev inhibitors, inhibitors of Tat-TAR-P-TEFb, immunomodulators (e.g., immunostimulators), immunotherapeutic agents, antibody-drug conjugates, gene modifiers, gene editors (such as CRISPR/Cas9, zinc finger nucleases, homing nucleases, synthetic nucleases, TALENs), cell therapies (such as chimeric antigen receptor T-cell, CAR-T, and engineered T-cell receptors, TCR-T, autologous T-cell therapies, engineered B cells, NK cells), latency reversing agents, compounds that target the HIV capsid, immune-based therapies, phosphatidylinositol 3-kinase (PI3K) inhibitors, HIV antibodies, bispecific antibodies and "antibody-like" therapeutic proteins, HIV p17 matrix protein inhibitors, IL-13 antagonists, peptidyl-prolyl cis-trans isomerase A modulators, protein disulfide isomerase inhibitors, complement C5a receptor antagonists, DNA methyltransferase inhibitor, Fatty acid synthase inhibitor, HIV vif gene modulators, Vif dimerization antagonists, HIV-1 viral infectivity factor inhibitors, HIV-1 Nef modulators, TNF alpha ligand inhibitors, HIV Nef inhibitors, Hck tyrosine kinase modulators, mixed lineage kinase-3 (MLK-3) inhibitors, HIV-1 splicing inhibitors, integrin antagonists, nucleoprotein inhibitors, splicing factor modulators, COMM domain containing protein 1 modulators, HIV ribonuclease H inhibitors, IFN antagonists, retrocyclin modulators, CD3 antagonists, CDK-4 inhibitors, CDK-6 inhibitors, CDK-9 inhibitors, Cytochrome P450 3 inhibitors, CXCR4 modulators, dendritic ICAM-3 grabbing nonintegrin 1 inhibitors, HIV GAG protein inhibitors, HIV POL protein inhibitors, Complement Factor H modulators, ubiquitin ligase inhibitors, deoxycytidine kinase inhibitors, cyclin dependent kinase inhibitors, HPK1 (MAP4K1) inhibitors, proprotein convertase PC9 stimulators, ATP dependent RNA helicase DDX3X inhibitors, reverse transcriptase priming complex inhibitors, G6PD and NADH-oxidase inhibitors, mTOR complex 1 inhibitors, mTOR complex 2 inhibitors, P-Glycoprotein modulators, RNA polymerase modulators, TAT protein inhibitors, Prolylendopeptidase inhibitors, Phospholipase A2 inhibitors, pharmacokinetic enhancers, HIV gene therapy, HIV vaccines, anti-HIV peptides, and combinations thereof.

In some embodiments, the additional therapeutic agent is selected from the group consisting of combination drugs for HIV, other drugs for treating HIV, HIV protease inhibitors, HIV reverse transcriptase inhibitors, HIV integrase inhibitors, HIV non-catalytic site (or allosteric) integrase inhibitors, HIV entry (fusion) inhibitors, HIV maturation inhibitors, latency reversing agents, capsid inhibitors, immune-based therapies, PI3K inhibitors, HIV antibodies, and bispecific antibodies, and "antibody-like" therapeutic proteins, and combinations thereof.

In some embodiments, the additional therapeutic agent or agents are selected from HIV protease inhibitors, HIV non-nucleoside or non-nucleotide inhibitors of reverse transcriptase, HIV nucleoside or nucleotide inhibitors of reverse transcriptase, HIV integrase inhibitors, HIV capsid inhibitors, gp41 inhibitors, CXCR4 inhibitors, gp120 inhibitors, CCR5 inhibitors, Nef inhibitors, latency reversing agents, HIV bNAbs, agonists of TLR7, TLR8, and TLR9, HIV vaccines, cytokines, immune checkpoint inhibitors, FLT3 ligands, T cell and NK cell recruiting bispecific antibodies, chimeric T cell receptors targeting HIV antigens, pharmacokinetic enhancers, and other drugs for treating HIV, and combinations thereof.

In some embodiments, the additional therapeutic agent or agents are selected from dolutegravir, cabotegravir, islatravir, darunavir, bictegravir, elsulfavirine, rilpivirine, and lenacapavir, and combinations thereof.

In some embodiments, the additional therapeutic agent or agents are selected from dolutegravir, cabotegravir, islatravir, darunavir, bictegravir, elsulfavirine, rilpivirine, and lenacapavir.

HIV Long Acting Therapies

In some embodiments, the one or more multi-specific antigen binding molecules described herein are combined or co-administered with an HIV long-acting anti-HIV regimen. Examples of as long acting regimens that can be combined or co-administered include without limitation cabotegravir, rilpivirine, any integrase LA, VM-1500 LAI, maraviroc (LAI), tenofovir implant, islatravir implant, doravirine, raltegravir, and long acting dolutegravir.

HIV Combination Drugs

In certain embodiments, the one or more multi-specific antigen binding molecules described herein are combined or co-administered with an HIV combination drug. Examples of combination drugs that can be employed with the one or more multi-specific antigen binding molecules described herein include ATRIPLA® (efavirenz, tenofovir disoproxil fumarate, and emtricitabine); COMPLERA® (EVIPLERA®; rilpivirine, tenofovir disoproxil fumarate, and emtricitabine); STRIBILD® (elvitegravir, cobicistat, tenofovir disoproxil fumarate, and emtricitabine); TRUVADA® (tenofovir disoproxil fumarate and emtricitabine; TDF+FTC); DESCOVY® (tenofovir alafenamide and emtricitabine); ODEFSEY® (tenofovir alafenamide, emtricitabine, and rilpivirine); GENVOYA® (tenofovir alafenamide, emtricitabine, cobicistat, and elvitegravir); darunavir, tenofovir alafenamide hemifumarate, emtricitabine, and cobicistat; efavirenz, lamivudine, and tenofovir disoproxil fumarate; lamivudine and tenofovir disoproxil fumarate; tenofovir and lamivudine; tenofovir alafenamide and emtricitabine; tenofovir alafenamide hemifumarate and emtricitabine; tenofovir alafenamide hemifumarate, emtricitabine, and rilpivirine; tenofovir alafenamide hemifumarate, emtricitabine, cobicistat, and elvitegravir; tenofovir analog; COMBIVIR® (zidovudine and lamivudine; AZT+3TC); EPZICOM® (LIVEXA®; abacavir sulfate and lamivudine; ABC+3TC); KALETRA® (ALUVIA®; lopinavir and ritonavir); TRIUMEQ® (dolutegravir, abacavir, and lamivudine); BIKTARVY® (bictegravir+emtricitabine+tenofovir alafenamide), DOVATO® (dolutegravir+lamivudine), TRIZIVIR® (abacavir sulfate, zidovudine, and lamivudine; ABC+AZT+3TC); atazanavir and cobicistat; atazanavir sulfate and cobicistat; atazanavir sulfate and ritonavir; darunavir and cobicistat; dolutegravir and rilpivirine; dolutegravir and rilpivirine hydrochloride; dolutegravir, abacavir sulfate, and lamivudine; lamivudine, nevirapine, and zidovudine; raltegravir and lamivudine; doravirine, lamivudine, and tenofovir disoproxil fumarate; doravirine, lamivudine, and tenofovir disoproxil; dolutegravir+lamivudine, lamivudine+abacavir+zidovudine, lamivudine+abacavir, lamivudine+tenofovir disoproxil fumarate, lamivudine+zidovudine+nevirapine, lopinavir+ritonavir, lopinavir+ritonavir+abacavir+lamivudine, lopinavir+ritonavir+zidovudine+lamivudine, tenofovir+lamivudine, and tenofovir disoproxil fumarate+emtricitabine+rilpivirine hydrochloride, lopinavir, ritonavir, zidovudine, lopinavir+ritonavir+abacavir+lamivudine, and lamivudine; cabotegravir+rilpivirine; 3BNC117+albuvirtide, elpida (elsulfavirine; VM-1500), VM-1500A, lenacapavir+islatravir (oral, injectable), and dual-target HIV-1 reverse transcriptase/nucleocapsid protein 7 inhibitors.

Other HIV Drugs

Examples of other drugs for treating HIV that can be combined with the one or more multi-specific antigen binding molecules described herein include aspernigrin C, acemannan, alisporivir, BanLec, deferiprone, Gamimune, metenkefalin, naltrexone, Prolastin, REP 9, RPI-MN, VSSP, Hlviral, SB-728-T, 1,5-dicaffeoylquinic acid, rHIV7-shI-TAR-CCRSRZ, AAV-eCD4-Ig gene therapy, MazF gene therapy, BlockAide, bevirimat derivatives, ABX-464, AG-1105, APH-0812, bryostatin analogs, BIT-225, BRII-732, BRII-778, CYT-107, CS-TATI-1, fluoro-beta-D-arabinose nucleic acid (FANA)-modified antisense oligonucleotides, FX-101, GILENYA® (fingolimod), griffithsin, HGTV-43, HPH-116, HS-10234, hydroxychloroquine, IMB-10035, IMO-3100, IND-02, JL-18008, LADAVRU, MK-1376, MK-2048, MK-4250, MK-8507, MK-8558, islatravir (MK-8591) (islatravir), NOV-205, OB-002H, ODE-Bn-TFV, PA-1050040 (PA-040), PC-707, PGN-007, QF-036, S-648414, SCY-635, SB-9200, SCB-719, TR-452, TEV-90110, TEV-90112, TEV-90111, TEV-90113, RN-18, DIACC-1010, Fasnall, Immuglo, 2-CLIPS peptide, HRF-4467, thrombospondin analogs, TBL-1004HI, VG-1177, xl-081, AVI-CO-004, rfhSP-D, [18F]-MC-225, URMC-099-C, RES-529, Verdinexor, IMC-M113V, IML-106, antiviral fc conjugate (AVC), VIR-576, nipamovir, Covimro, and ABBV-1882.

HIV Protease Inhibitors

In certain embodiments, the one or more multi-specific antigen binding molecules described herein are combined or co-administered with an HIV protease inhibitor. Examples of HIV protease inhibitors that can be combined with the one or more multi-specific antigen binding molecules, described herein, include amprenavir, atazanavir, brecanavir, darunavir, fosamprenavir, fosamprenavir calcium, indinavir, indinavir sulfate, lopinavir, nelfinavir, nelfinavir mesylate, ritonavir, saquinavir, saquinavir mesylate, tipranavir, ASC-09+ritonavir, AEBL-2, DG-17, GS-1156, TMB-657 (PPL-100), T-169, BL-008, MK-8122, TMB-607, GRL-02031, and TMC-310911. Additional examples of protease inhibitors that can be combined or co-administered are disclosed in U.S. Pat. Nos. 10,294,234, US2020030327 and US2019210978.

HIV Ribonuclease H Inhibitors

In certain embodiments, the one or more multi-specific antigen binding molecules described herein are combined or co-administered with an HIV ribonuclease H inhibitor. Examples of HIV ribonuclease H inhibitors that can be combined with the one or more multi-specific antigen binding molecules described herein include NSC-727447.

HIV Nef Inhibitors

In certain embodiments, the one or more multi-specific antigen binding molecules described herein are combined or co-administered with an HIV Nef inhibitor. Examples of HIV Nef inhibitors that can be combined with the one or more multi-specific antigen binding molecules described herein include FP-1.

HIV Reverse Transcriptase Inhibitors

In certain embodiments, the one or more multi-specific antigen binding molecules described herein are combined or co-administered with a non-nucleoside or non-nucleotide inhibitor. Examples of HIV non-nucleoside or non-nucleotide inhibitors of reverse transcriptase that can be combined with the one or more multi-specific antigen binding molecules, described herein, include dapivirine, delavirdine, delavirdine mesylate, doravirine, efavirenz, etravirine, lentinan, nevirapine, rilpivirine, ACC-007, ACC-008, AIC-292, F-18, KM-023, PC-1005, M1-TFV, M2-TFV, VM-1500A-LAI, PF-3450074, elsulfavirine (sustained release oral, HIV infection), doravirine+islatravir (fixed dose combination/oral tablet formulation, HIV-1 infection), elsulfavirine (long-acting injectable nanosuspension, HIV infection), and elsulfavirine (VM-1500).

In certain embodiments, the one or more multi-specific antigen binding molecules described herein are combined or co-administered with long acting anti-HIV regimen. Examples of drugs that are being developed as long acting anti-HIV regimens that can be co-administered include without limitation cabotegravir LA, rilpivirine LA, cabotegravir LA+rilpivirine LA, elvitegravir (extended release), lenacapavir long acting, raltegravir long acting, darunavir long acting, any integrase LA, VM-1500A-LAI, VM-3500, maraviroc (LAI), T-1144, ODE-Bn-TFV, CP-112, S-648414, tenofovir implant, tenofovir long acting, tenofovir prodrug long acting, islatravir (MK-8591) subdermal implant, long-acting dolutegravir, long acting raltegravir+lamivudine, transdermal devices that can deliver HIV drugs, such as transdermal tenofovir (WO2020092990).

In certain embodiments, the one or more multi-specific antigen binding molecules described herein are combined or co-administered with an HIV nucleoside or nucleotide inhibitor. Examples of HIV nucleoside or nucleotide inhibitors of reverse transcriptase that can be combined with the one or more multi-specific antigen binding molecules, described herein, include adefovir, adefovir dipivoxil, azvudine, emtricitabine, tenofovir, tenofovir alafenamide, tenofovir alafenamide fumarate, tenofovir alafenamide hemifumarate, tenofovir disoproxil, tenofovir disoproxil fumarate, tenofovir octadecyloxyethyl ester (AGX-1009), tenofovir disoproxil hemifumarate, VIDEX® and VIDEX EC® (didanosine, ddl), abacavir, abacavir sulfate, alovudine, apricitabine, censavudine, didanosine, elvucitabine, festinavir, fosalvudine tidoxil, CMX-157, dapivirine, doravirine, etravirine, OCR-5753, tenofovir disoproxil orotate, fozivudine tidoxil, lamivudine, phosphazid, stavudine, zalcitabine, zidovudine, rovafovir etalafenamide (GS-9131), GS-9148, MK-8504, islatravir (MK-8591), MK-8583, VM-2500 and KP-1461.

Additional examples of HIV nucleoside or nucleotide inhibitors of reverse transcriptase include, but are not limited to those described in U.S. patent No. US2007049754, US2016250215, US2016237062, US2016251347; US2002119443, US2013065856, US2013090473, US2014221356; and WO04096286.

HIV Integrase Inhibitors

In certain embodiments, the one or more multi-specific antigen binding molecules described herein are combined or co-administered with an HIV integrase inhibitor. Examples of HIV integrase inhibitors that can be combined with the one or more multi-specific antigen binding molecules, described herein, include elvitegravir, elvitegravir (extended-release microcapsules), curcumin, derivatives of curcumin, chicoric acid, derivatives of chicoric acid, 3,5-dicaffeoylquinic acid, derivatives of 3,5-dicaffeoylquinic acid, aurintricarboxylic acid, derivatives of aurintricarboxylic acid, caffeic acid phenethyl ester, derivatives of caffeic acid phenethyl ester, tyrphostin, derivatives of tyrphostin, quercetin, derivatives of quercetin, raltegravir, PEGylated raltegravir, dolutegravir, JTK-351, bictegravir, AVX-15567, cabotegravir, cabotegravir (long-acting injectable), diketo quinolin-4-1 derivatives, integrase-LEDGF inhibitor, ledgins, M-522, M-532, MK-0536, NSC-310217, NSC-371056, NSC-48240, NSC-642710, NSC-699171, NSC-699172, NSC-699173, NSC-699174, stilbenedisulfonic acid, T-169, STP-0404, VM-3500, XVIR-110, and ACC-017.

In certain embodiments, the one or more multi-specific antigen binding molecules described herein are combined or co-administered with a HIV non-catalytic site, or allosteric, integrase inhibitor (NCINI). Examples of HIV non-catalytic site, or allosteric, integrase inhibitors (NCINI) that can be combined with the one or more multi-specific antigen binding molecules, described herein, include CX-05045, CX-05168, and CX-14442. Additional examples of HIV capsid inhibitors that can be combined or co-administered include without limitation those described in U.S. Pat. Nos. US2014221356 and US2016016973.

HIV Viral Infectivity Factor Inhibitor

In certain embodiments, the one or more multi-specific antigen binding molecules described herein are combined or co-administered with an HIV viral infectivity factor inhibitor. Examples of HIV viral infectivity factor inhibitors that can be combined with the one or more multi-specific antigen binding molecules described herein include 2-amino-N-(2-methoxyphenyl)-6-((4-nitrophenyl)thio)benzamide derivatives, and Irino-L.

HIV Entry (Fusion) Inhibitors

In certain embodiments, the one or more multi-specific antigen binding molecules described herein are combined or co-administered with an HIV entry (fusion) inhibitor. Examples of HIV entry (fusion) inhibitors that can be combined with the one or more multi-specific antigen binding molecules, described herein, include AAR-501, LBT-5001, cenicriviroc, CCR5 inhibitors, gp41 inhibitors, CD4 attachment inhibitors, gp120 inhibitors, gp160 inhibitors, CXCR4 inhibitors and D-peptide HIV entry inhibitors (e.g., cholesterol-PIE12-trimer (CPT31)).

In certain embodiments, the one or more multi-specific antigen binding molecules described herein are combined or co-administered with a C-C motif chemokine receptor 5 (CCR5; NCBI Gene ID: 1234) inhibitor. Examples of CCR5 inhibitors that can be combined with the one or more multi-specific antigen binding molecules, described herein, include aplaviroc, MK-7690 (vicriviroc), maraviroc, maraviroc (long-acting injectable nanoemulsion), cenicriviroc, leronlimab (PRO-140), adaptavir (RAP-101), nifeviroc (TD-0232), anti-GP120/CD4 or CCR5 bispecific antibodies, B-07, MB-66, polypeptide C25P, TD-0680, thiraviroc, vMIP (Haimipu), CCR5/CCR2 dual inhibitors, e.g., cenicriviroc, BMS-813160.

In certain embodiments, the one or more multi-specific antigen binding molecules described herein are combined or co-administered with a CXCR4 inhibitor. Examples of CXCR4 inhibitors that can be combined with the one or more multi-specific antigen binding molecules, described herein, include plerixafor, ALT-1188, N15 peptide, vMIP (Haimipu), BL-8040, LY2510924, burixafor (TG-0054), X4P-002 and X4P-001-IO.

In certain embodiments, the one or more multi-specific antigen binding molecules described herein are combined or co-administered with a gp41 inhibitor. Examples of gp41 inhibitors that can be combined with the one or more multi-specific antigen binding molecules, described herein, include albuvirtide, enfuvirtide, griffithsin (gp41/gp120/gp160 inhibitor), BMS-986197, enfuvirtide biobetter, enfuvirtide biosimilar, HIV-1 fusion inhibitors (P26-Bapc), ITV-1, ITV-2, ITV-3, ITV-4, CPT-31, Cl3hmAb, lipuvirtide, PIE-12 trimer and sifuvirtide.

In certain embodiments, the one or more multi-specific antigen binding molecules described herein are combined or co-administered with a CD4 attachment inhibitor. Examples of CD4 attachment inhibitors that can be combined with the one or more multi-specific antigen binding molecules, described herein, include ibalizumab and CADA analogs.

In certain embodiments, the one or more multi-specific antigen binding molecules described herein are combined or co-administered with a gp120 inhibitor. Examples of gp120 inhibitors that can be combined with the one or more multi-specific antigen binding molecules, described herein, include anti-HIV microbicide, Radha-108 (receptol) 3B3-PE38, BMS818251, BanLec, bentonite-based nanomedicine, fostemsavir tromethamine, IQP-0831, VVX-004, and BMS-663068.

In certain embodiments, the one or more multi-specific antigen binding molecules described herein are combined or co-administered with a gp160 inhibitor. Examples of gp160 inhibitors that can be combined with the one or more multi-specific antigen binding molecules described herein include fangchinoline.

HIV Maturation Inhibitors

In certain embodiments, the one or more multi-specific antigen binding molecules described herein are combined or co-administered with an HIV maturation inhibitor. Examples of HIV maturation inhibitors that can be combined with the one or more multi-specific antigen binding molecules, described herein, include BMS-955176, GSK-3640254 and GSK-2838232.

Capsid Inhibitors

In certain embodiments, the one or more multi-specific antigen binding molecules described herein are combined or co-administered with a capsid inhibitor. Examples of capsid inhibitors that can be combined with the one or more multi-specific antigen binding molecules, described herein, include capsid polymerization inhibitors or capsid disrupting compounds, HIV nucleocapsid p7 (NCp7) inhibitors such as azodicarbonamide, HIV p24 capsid protein inhibitors, lenacapavir (GS-6207), GS-CA1, AVI-621, AVI-101, AVI-201, AVI-301, and AVI-CAN1-15 series, PF-3450074, HIV-1 capsid inhibitors (HIV-1 infection, Shandong University), and compounds described in Intl. Patent Publ. No.

WO2019/087016. Additional examples of capsid inhibitors that can be combined or co-administered include without limitation those described in U.S. Patent Publ. Nos. US2018051005 and US2016108030.

Cytochrome P450 3 Inhibitors

In certain embodiments, the one or more multi-specific antigen binding molecules described herein are combined or co-administered with a cytochrome P450 3 inhibitor. Examples of Cytochrome P450 3 inhibitors that can be combined or co-administered include without limitation those described in U.S. Pat. No. 7,939,553.

RNA Polymerase Modulators

In certain embodiments, the one or more multi-specific antigen binding molecules described herein are combined or co-administered with a RNA polymerase modulator (e.g., inhibitor). Examples of RNA polymerase modulators (e.g., inhibitors) include without limitation those described in U.S. Pat. Nos. 10,065,958 and 8,008,264.

Latency Reversing Agents

In certain embodiments, the one or more multi-specific antigen binding molecules described herein are combined or co-administered with an HIV latency reversing agent. Examples of latency reversing agents that can be combined with the one or more multi-specific antigen binding molecules, described herein, include IL-15 receptor agonists (e.g., ALT-803; interleukin-15/Fc fusion protein (e.g., XmAb24306); recombinant interleukin-15 (e.g., AM0015, NIZ-985); pegylated IL-15 (e.g., NKTR-255)); toll-like receptor (TLR) agonists (including TLR7 agonists, e.g., GS-9620 and TLR8 agonists, e.g., selgantolimod (GS-9688)), TLR9 agonists, e.g., lefitolimod (MGN-1703)), histone deacetylase (HDAC) inhibitors, proteasome inhibitors such as velcade, protein kinase C (PKC) activators, Smyd2 inhibitors, BET-bromodomain 4 (BRD4) inhibitors (such as ZL-0580, apabetalone), ionomycin, IAP antagonists (inhibitor of apoptotis proteins, such as APG-1387, LBW-242), SMAC mimetics (including ciapavir, BI-891065, TL32711, LCL161, GDC-0917, HGS1029, AT-406, APG-1387, LCL-161 (NVP-LCL161)), Debio-1143), PMA, SAHA (suberanilohydroxamic acid, or suberoyl, anilide, and hydroxamic acid), NIZ-985, IL-15 modulating antibodies (including IL-15, IL-15 fusion proteins and IL-15 receptor agonists, e.g., ALT-803), JQ1, disulfiram, amphotericin B, and ubiquitin inhibitors such as largazole analogs, APH-0812, and GSK-343. Examples of HDAC inhibitors include romidepsin, vorinostat, and panobinostat. Examples of PKC activators include indolactam, prostratin, ingenol B, and DAG-lactones. Additional examples of TLR7 agonists that can be combined or co-administered include without limitation described in U.S. Patent Publ. No. US2010143301. Additional examples of TLR8 agonists that can be combined or co-administered include without limitation described in U.S. Patent Publ. No. US2017071944.

Histone Deacetylase (HDAC) Inhibitors

In various embodiments, the one or more multi-specific antigen binding molecules as described herein, are combined or co-administered with an inhibitor of a histone deacetylase, e.g., histone deacetylase 1 (HDAC1; NCBI Gene ID: 3065), histone deacetylase 2 (HDAC2; NCBI Gene ID: 3066), histone deacetylase 3 (HDAC3; NCBI Gene ID: 8841), histone deacetylase 4 (HDAC4; NCBI Gene ID: 9759), histone deacetylase 5 (HDAC5; NCBI Gene ID: 10014), histone deacetylase 6 (HDAC6; NCBI Gene ID: 10013), histone deacetylase 7 (HDAC7; NCBI Gene ID: 51564), histone deacetylase 8 (HDAC8; NCBI Gene ID: 55869), histone deacetylase 9 (HDAC9; NCBI Gene ID: 9734), histone deacetylase 11 (HDAC11; NCBI Gene ID: 79885). Examples of HDAC inhibitors that can be combined with the one or more multi-specific antigen binding molecules, described herein, include without limitation, abexinostat, ACY-241, AR-42, BEBT-908, belinostat, CKD-581, CS-055 (HBI-8000), CT-101, CUDC-907 (fimepinostat), entinostat, givinostat, mocetinostat, panobinostat, pracinostat, quisinostat (JNJ-26481585), resminostat, ricolinostat, romidepsin, SHP-141, TMB-ADC, valproic acid (VAL-001), vorinostat, tinostamustine, remetinostat, and entinostat.

Immune-Based Therapies

In certain embodiments, the one or more multi-specific antigen binding molecules described herein are combined or co-administered with an immune-based therapy. Examples of immune-based therapies include agonists or stimulators of a toll-like receptor (TLR) (e.g., one or more of TLR1, TLR2, TLR3, TLR4, TLR5, TLR6, TLR7, TLR8, TLR9, and TLR10); programmed cell death protein 1 (PD-1) modulators; programmed death-ligand 1 (PD-L1) modulators; IL-15 receptor agonists (e.g., ALT-803; interleukin-15/Fc fusion protein (e.g., XmAb24306); recombinant interleukin-15 (e.g., AM0015, NIZ-985); pegylated IL-15 (e.g., NKTR-255)); DermaVir; interleukin-7; plaquenil (hydroxychloroquine); proleukin (aldesleukin, IL-2); interferon alfa; interferon alfa-2b; interferon alfa-n3; pegylated interferon alfa; interferon gamma; hydroxyurea; mycophenolate mofetil (MPA) and its ester derivative mycophenolate mofetil (MMF); ribavirin; polymer polyethyleneimine (PEI); gepon; IL-12; WF-10; VGV-1; MOR-22; BMS-936559; CYT-107, normferon, peginterferon alfa-2a, peginterferon alfa-2b, RPI-MN, STING modulators, RIG-I modulators, NOD2 modulators, SB-9200, and IR-103.

Toll-Like Receptor (TLR) Agonists

In various embodiments, the one or more multi-specific antigen binding molecules as described herein, are combined or co-administered with an agonist of a toll-like receptor (TLR), e.g., an agonist of one or more of TLR1, TLR2, TLR3, TLR4, TLR5, TLR6, TLR7, TLR8, TLR9, and TLR10). Example TLR7 agonists that can be co-administered or combined with the one or more multi-specific antigen binding molecules, described herein, include without limitation AL-034, DSP-0509, GS-9620 (vesatolimod), vesatolimod analogs, LHC-165, TMX-101 (imiquimod), GSK-2245035, resiquimod, DSR-6434, DSP-3025, IMO-4200, MCT-465, MEDI-9197, 3M-051, SB-9922, 3M-052, Limtop, TMX-30X, TMX-202, RG-7863, RG-7854, RG-7795, and the compounds disclosed in US20100143301 (Gilead Sciences), US20110098248 (Gilead Sciences), and US20090047249 (Gilead Sciences), US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). An TLR7/TLR8 agonist that can be co-administered is NKTR-262, telratolimod and BDB-001. Example TLR8 agonists that can be co-administered or combined with the one or more multi-specific antigen binding molecules, described herein, include without limitation E-6887, IMO-4200, IMO-8400, IMO-9200, MCT-465, MEDI-9197, motolimod, resiquimod, selgantolimod (GS-9688), VTX-1463, VTX-763, 3M-051, 3M-052, and the compounds disclosed in US20140045849 (Janssen), US20140073642 (Janssen), WO2014/056953 (Janssen), WO2014/076221 (Janssen), WO2014/128189 (Janssen), US20140350031 (Janssen), WO2014/023813 (Janssen), US20080234251 (Array Biopharma), US20080306050 (Array Biopharma), US20100029585 (Ventirx Pharma), US20110092485 (Ventirx Pharma), US20110118235 (Ventirx Pharma), US20120082658 (Ventirx Pharma), US20120219615 (Ventirx Pharma), US20140066432 (Ventirx Pharma), US20140088085 (Ventirx Pharma), US20140275167 (Novira Therapeutics), and US20130251673 (Novira Therapeutics). Example TLR9 agonists that can be co-administered include without limitation AST-008, cobitolimod, CMP-001, IMO-2055, IMO-2125, S-540956, litenimod, MGN-1601, BB-001, BB-006, IMO-3100, IMO-8400, IR-103, IMO-9200, agatolimod, DIMS-9054, DV-1079, DV-1179, AZD-1419, lefitolimod (MGN-1703), CYT-003, CYT-003-QbG10, tilsotolimod and PUL-042. Examples of TLR3 agonist include rintatolimod, poly-ICLC, RIBOXXON®, Apoxxim, RIBOXXIM®, IPH-33, MCT-465, MCT-475, and ND-1.1. Examples of TLR4 agonist include G-100, and GSK-1795091.

CDK Inhibitors or Antagonists

In certain embodiments, the one or more multi-specific antigen binding molecules described herein are combined or co-administered with inhibitor of cyclin dependent kinase 1 (CDK1, CDCl2; CDCl28A; P34CDCl$_2$; NCBI Gene ID: 983); cyclin dependent kinase 2 (CDK2, CDKN2; p33 (CDK2); NCBI Gene ID: 1017); cyclin dependent kinase 3 (CDK3; NCBI Gene ID: 1018); cyclin dependent kinase 4 (CDK4, CMM3; PSK-J3; NCBI Gene ID: 1019); cyclin dependent kinase 6 (CDK6, MCPH12; PLSTIRE; NCBI Gene ID: 1021); cyclin dependent kinase 7 (CDK7, CAK; CAK1; HCAK; MO15; STK1; CDKN7; p39MO15; NCBI Gene ID: 1022); cyclin dependent kinase 9 (CDK9, TAK; C-2k; CTK1; CDCl$_2$L4; PITALRE; NCBI Gene ID: 1025). Inhibitors of one or more of CDK 1, 2, 3, 4, 6, 7 and 9 that can be combined or co-administered include without limitation abemaciclib, alvocidib (HMR-1275, flavopiridol), AT-7519, dinaciclib, ibrance, FLX-925, LEE001, palbociclib, ribociclib, rigosertib, selinexor, UCN-01, SY1365, CT-7001, SY-1365, G1T38, milciclib, trilaciclib, PF-06873600, AZD4573, and TG-02. In some embodiments, the CDK4/CDK6/CDK9 inhibitor or antagonist is selected from the group consisting of VS2-370.

Stimulator of Interferon Genes (STING) Agonists

In some embodiments, the one or more multi-specific antigen binding molecules described herein are combined or co-administered with an agonist of stimulator of interferon response cGAMP interactor 1 (STING1; NCBI Gene ID: 340061). In some embodiments, the STING receptor agonist or activator is selected from the group consisting of ADU-S100 (MIW-815), SB-11285, MK-1454, SR-8291, AdVCA0848, GSK-532, SYN-STING, MSA-1, SR-8291, STING agonist (latent HIV), GSK3745417, 5,6-dimethyl-xanthenone-4-acetic acid (DMXAA), cyclic-GAMP (cGAMP) and cyclic-di-AMP.

RIG-I Agonists

In certain embodiments, the one or more multi-specific antigen binding molecules described herein are combined or co-administered with an agonist of DExD/H-box helicase 58 (DDX58; a.k.a., RIG-I, RIG1, RIGI, RLR-1, SGMRT2; NCBI Gene ID: 23586). In some embodiments, the agents described herein are combined or co-administered with a RIG-I modulator such as RGT-100, or NOD2 modulator, such as SB-9200 (a.k.a., GS 9992; inarigivir soproxil), and IR-103. An illustrative RIG-I agonist is KIN1148, described by Hemann, et al., J Immunol May 1, 2016, 196 (1 Supplement) 76.1. Additional RIG-I agonists are described, e.g., in Elion, et al., Cancer Res. (2018) 78(21):6183-6195; and Liu, et al., J Virol. (2016) 90(20):9406-19. RIG-I agonists are commercially available, e.g., from Invivogen (invivogen.com).

LAG-3 and TIM-3 Inhibitors

In certain embodiments, the one or more multi-specific antigen binding molecules described herein are combined or co-administered with an anti-TIM-3 (a.k.a., hepatitis A virus cellular receptor 2 antibody (HAVCR2; NCBI Gene ID: 84868), such as TSR-022, LY-3321367, MBG-453, INCAGN-2390. In some embodiments, the one or more multi-specific antigen binding molecules described herein are combined or co-administered with an anti-lymphocyte activating 3 (LAG3, a.k.a., CD223; NCBI Gene ID: 3902) antibody, such as relatlimab (ONO-4482), LAG-525, MK-4280, REGN-3767, INCAGN2385.

Cytokine Receptor Agonists

In various embodiments, the one or more multi-specific antigen binding molecules described herein are combined or co-administered with one or more cytokine receptor or chemokine receptor agonists. Illustrative cytokine or chemokine receptor agonists that can be co-administered include without limitation IL-12, IL-18, gamma chain-dependent cytokines (e.g., IL-2, IL-7, IL-9, IL-15 and IL-21) and fms related tyrosine kinase 3 (FLT3) ligand (FLT3LG).

Examples of IL-2 receptor agonists that can be combined or co-administered include proleukin (aldesleukin, IL-2); BC-IL (Cel-Sci), pegylated IL-2 (e.g., NKTR-214 (bempegaldesleukin)); modified variants of IL-2 (e.g., THOR-707), AIC-284, ALKS-4230, CUI-101 and Neo-2/15.

Examples of IL-15 receptor agonists that can be combined or co-administered include without limitation PRGN-3006, ALT-803, NKTR-255, and hetIL-15, interleukin-15/Fc fusion protein (e.g., XmAb24306); recombinant interleukin-15 (e.g., AM0015, NIZ-985); pegylated IL-15 (e.g., NKTR-255, Synthorin), hetIL-15, SO-C101, P-22339, and the IL-15-PD-1 fusion protein N-809.

Examples of IL-12 receptor agonists that can be combined or co-administered include IL-12A (NCBI Gene ID: 3592)+IL-12B (NCBI Gene ID: 3593) mRNAs, such as MEDI1191; IL-12 gene stimulators, such as EGEN-001, tavokinogene telseplasmid; dendritic cells transduced to express IL-12, such as DC-RTS-IL-12; autologous T-Cells genetically engineered to secrete IL-12 and to target the mucin 16, cell surface associated (MUC16, a.k.a., CA125; NCBI Gene ID: 94025), such as JCAR-020; and mRNA encoding the cytokines interleukin-12 single chain (IL-125c), interleukin-15+IL15RA sushi domain (IL-15sushi), interferon alpha (IFNα) and granulocyte-macrophage colony-stimulating factor (GM-CSF), such as SAR441000 (BNT131).

An illustrative IL-7 receptor agonist that can be co-administered includes CYT-107.

Illustrative fms related tyrosine kinase 3 (FLT3) ligand (FLT3LG) agonists that can be combined or co-administered include GS-3583 and CDX-301.

Interferon Receptor Ligands

In various embodiments, the one or more multi-specific antigen binding molecules described herein are combined or co-administered with one or more interferon receptor (e.g., interferon alpha and beta receptor subunit 1 (IFNAR1; NCBI Gene ID: 3454); interferon alpha and beta receptor subunit 2 (IFNAR2; NCBI Gene ID: 3455); interferon gamma receptor 1 (IFNGR1; NCBI Gene ID: 3459); interferon gamma receptor 2 (IFNGR2; NCBI Gene ID: 3460) ligands, which can be one or more of recombinant, PEGylated, fusion proteins and conjugates. Examples of interferon receptor ligands that can be combined or co-administered include an interferon alpha-1b, an interferon alpha-2a, an interferon alpha-2b, an interferon beta-1a, and an interferon gamma. Illustrative interferon alpha-1b that can be combined or co-administered include without limitation, recombinant human interferon alpha-1b, interferon alpha 1b, PEGylated interferon alpha-1b, interferon alpha 1b (HAPGEN®). Illustrative interferon alpha-2a that can be combined or co-administered include without limitation, recombinant human interferon alpha-2a, interferon alfa 2a, PEG-IFN-alpha, pegylated interferon alpha-2a (PEGASYS®), YPEG-interferon alfa-2a (YPEG-rhIFNalpha-2a), interferon alpha-2a biosimilar (Biogenomics), rHSA-IFN alpha-2a (recombinant human serum albumin interferon alpha 2a fusion protein), interferon alfa-2a follow-on biologic (Biosidus) (Inmutag, Inter 2A). Illustrative interferon alpha-2b that can be combined or co-administered include without limitation, recombinant human interferon alpha-2b, alpha-2b (INTRON A®), interferon alfa-2b (from numerous sources, including, e.g., Amega, Axxo, IFN, Laboratorios Bioprofarma, Virchow, Zydus-Cadila, BioGeneric Pharma, Changchun Institute of Biological Products), ropeginterferon alfa-2b (AOP-2014, P-1101, PEG IFN alpha-2b), peginterferon alfa-2b (Amega), Ypeginterferon alfa-2b (YPEG-rhIFNalpha-2b), peginterferon alfa-2b (PEG-INTRON®), rHSA-IFN alpha 2b (recombinant human serum albumin interferon alpha 2b fusion protein), veltuzumab-IFN alpha 2b conjugate, interferon alfa-2b follow-on biologic (Biosidus-Bioferon, Citopheron, Ganapar, Beijing Kawin Technology-Kaferon). Additional illustrative interferon alpha and beta receptor ligands that can be combined or co-administered include without limitation Veldona, Infradure, Roferon-A, Algeron, Alfarona, Ingaron (interferon gamma), rSIFN-co (recombinant super compound interferon), MOR-22, Bioferon, Novaferon, Inmutag (Inferon), MULTIFERON® (Alfanative, Viragen), interferon alfa-n1 (HUMOFERON®, SM-10500, Sumiferon), Shaferon, Alfaferone, interferon-alpha 2 (CJ), Laferonum, VIPEG, BLAUFERON-A, BLAUFERON-B, Dynavax (SD-101), Intermax Alpha, Realdiron, Lanstion, Pegaferon, PDferon-B PDferon-B, Pegnano, Feronsure, PegiHep, Optipeg A, Realfa 2B, Reliferon, Reaferon-EC, Roferon-A (Canferon, Ro-25-3036), Proquiferon, Uniferon, Urifron, Anterferon, Shanferon, Layfferon, Shang Sheng Lei Tai, INTEFEN, SINOGEN, Fukangtai, Pegstat, SFR-9216, Interapo (Interapa), GEPON®, NORMFERON™. Illustrative interferon beta-1a that can be combined or co-administered include without limitation, interferon beta-1a (AVONEX®). Illustrative interferon gamma receptor ligands that can be combined or co-administered include without limitation, interferon gamma (OH-6000, Ogamma 100) and RPI-MN (modified cobratoxin).

Immune Checkpoint Receptor Protein Modulators

In various embodiments, the one or more multi-specific antigen binding molecules described herein are combined or co-administered with one or more blockers or inhibitors of inhibitory immune checkpoint proteins or receptors and/or with one or more stimulators, activators or agonists of one or more stimulatory immune checkpoint proteins or receptors. Blockade or inhibition of inhibitory immune checkpoints can positively regulate T-cell or NK cell activation and prevent immune escape of infected cells. Activation or stimulation of stimulatory immune check points can augment the effect of immune checkpoint inhibitors in infective therapeutics. In various embodiments, the immune checkpoint proteins or receptors regulate T cell responses (e.g., reviewed in Xu, et al., J Exp Clin Cancer Res. (2018) 37:110). In various embodiments, the immune checkpoint proteins or receptors regulate NK cell responses (e.g., reviewed in Davis, et al., Semin Immunol. (2017) 31:64-75 and Chiossone, et al., Nat Rev Immunol. (2018) 18(11):671-688).

Examples of immune checkpoint proteins or receptors that can be combined with the one or more multi-specific antigen binding molecules described herein include without limitation CD27 (NCBI Gene ID: 939); CD70 (NCBI Gene ID: 970); CD40 (NCBI Gene ID: 958); CD40LG (NCBI Gene ID: 959); CD47 (NCBI Gene ID: 961); CD48 (SLAMF2; NCBI Gene ID: 962); transmembrane and immunoglobulin domain containing 2 (TMIGD2, CD28H; NCBI Gene ID: 126259); CD84 (LY9B, SLAMF5; NCBI Gene ID: 8832); CD96 (NCBI Gene ID: 10225); CD160 (NCBI Gene ID: 11126); MS4A1 (CD20; NCBI Gene ID: 931); CD244 (SLAMF4; NCBI Gene ID: 51744); CD276 (B7H3; NCBI Gene ID: 80381); V-set domain containing T cell activation inhibitor 1 (VTCN1, B7H4; NCBI Gene ID: 79679); V-set immunoregulatory receptor (VSIR, B7H5, VISTA; NCBI Gene ID: 64115); immunoglobulin superfamily member 11 (IGSF11, VSIG3; NCBI Gene ID: 152404); natural killer cell cytotoxicity receptor 3 ligand 1 (NCR3LG1, B7H6; NCBI Gene ID: 374383); HERV-H LTR-associating 2 (HHLA2, B7H7; NCBI Gene ID: 11148); inducible T cell co-stimulator (ICOS, CD278; NCBI Gene ID: 29851); inducible T cell co-stimulator ligand (ICOSLG, B7H2; NCBI Gene ID: 23308); TNF receptor superfamily member 4 (TNFRSF4, OX40; NCBI Gene ID: 7293); TNF superfamily member 4 (TNFSF4, OX40L; NCBI Gene ID: 7292); TNFRSF8 (CD30; NCBI Gene ID: 943); TNFSF8 (CD30L; NCBI Gene ID: 944); TNFRSF10A (CD261, DR4, TRAILR1; NCBI Gene ID: 8797); TNFRSF9 (CD137; NCBI Gene ID: 3604); TNFSF9 (CD137L; NCBI Gene ID: 8744); TNFRSF10B (CD262, DR5, TRAILR2; NCBI Gene ID: 8795); TNFRSF10 (TRAIL; NCBI Gene ID: 8743); TNFRSF14 (HVEM, CD270; NCBI Gene ID: 8764); TNFSF14 (HVEML; NCBI Gene ID: 8740); CD272 (B and T lymphocyte associated (BTLA); NCBI Gene ID: 151888); TNFRSF17 (BCMA, CD269; NCBI Gene ID: 608); TNFSF13B (BAFF; NCBI Gene ID: 10673); TNFRSF18 (GITR; NCBI Gene ID: 8784); TNFSF18 (GITRL; NCBI Gene ID: 8995); MHC class I polypeptide-related sequence A (MICA; NCBI Gene ID: 100507436); MHC class I polypeptide-related sequence B (MICB; NCBI Gene ID: 4277); CD274 (CD274, PDL1, PD-L1; NCBI Gene ID: 29126); programmed cell death 1 (PDCD1, PD1, PD-1; NCBI Gene ID: 5133); cytotoxic T-lymphocyte associated protein 4 (CTLA4, CD152; NCBI Gene ID: 1493); CD80 (B7-1; NCBI Gene ID: 941); CD28 (NCBI Gene ID: 940); nectin cell adhesion molecule 2 (NECTIN2, CD112; NCBI Gene ID: 5819); CD226 (DNAM-1; NCBI Gene ID: 10666); Poliovirus receptor (PVR) cell adhesion molecule (PVR, CD155; NCBI Gene ID: 5817); PVR related immunoglobulin domain containing (PVRIG, CD112R; NCBI Gene ID: 79037); T cell immunoreceptor with Ig and ITIM domains (TIGIT; NCBI Gene ID: 201633); T cell immunoglobulin and mucin domain containing 4 (TIMD4; TIM4; NCBI Gene ID: 91937); hepatitis A virus cellular receptor 2 (HAVCR2, TIMD3, TIM3; TIM-3; NCBI Gene ID: 84868); galectin 9 (LGALS9; NCBI Gene ID: 3965); lymphocyte activating 3 (LAG3, LAG-3; CD223; NCBI Gene ID: 3902); signaling lymphocytic activation molecule family member 1 (SLAMF1, SLAM, CD150; NCBI Gene ID: 6504); lymphocyte antigen 9 (LY9, CD229, sialic acid binding Ig like lectin 7 (SIGLEC7; p75; QA79; AIRM1; CD328; CDw328; D-siglec; SIGLEC-7; SIGLECP2; SIGLEC19P; p75/AIRM1; NCBI Gene ID: 27036); sialic acid binding Ig like lectin 9 (SIGLEC9; CD329; CDw329; FOAP-9; siglec-9; OBBP-LIKE; NCBI Gene ID: 27180); SLAMF3; NCBI Gene ID: 4063); SLAM family member 6 (SLAMF6, CD352; NCBI Gene ID: 114836); SLAM family member 7 (SLAMF7, CD319; NCBI Gene ID: 57823); UL16 binding protein 1 (ULBP1; NCBI Gene ID: 80329); UL16 binding protein 2 (ULBP2; NCBI Gene ID: 80328); UL16 binding protein 3 (ULBP3; NCBI Gene ID: 79465); retinoic acid early transcript 1E (RAET1E; ULBP4; NCBI Gene ID: 135250); retinoic acid early transcript 1G (RAET1G; ULBP5; NCBI Gene ID: 353091); retinoic acid early transcript 1L (RAET1L; ULBP6; NCBI Gene ID: 154064); killer cell lectin like receptor C1 (KLRC1, NKG2A, CD159A; NCBI Gene ID: 3821); killer cell lectin like receptor K1 (KLRK1, NKG2D, CD314; NCBI Gene ID: 22914); killer cell lectin like receptor C2 (KLRC2, CD159c, NKG2C; NCBI Gene ID: 3822); killer cell lectin like receptor C3 (KLRC3, NKG2E; NCBI Gene ID: 3823); killer cell lectin like receptor C4 (KLRC4, NKG2F; NCBI Gene ID: 8302); killer cell lectin like receptor D1 (KLRD1; NCBI Gene ID: 3824); killer cell lectin like receptor G1 (KLRG1; 2F1; MAFA; MAFA-L; CLEC15A; MAFA-2F1; MAFA-LIKE; NCBI Gene ID: 10219); killer cell immunoglobulin like receptor, two Ig domains and long cytoplasmic tail 1 (KIR2DL1; NCBI Gene ID: 3802); killer cell immunoglobulin like receptor, two Ig domains and long cytoplasmic tail 2 (KIR2DL2; NCBI Gene ID: 3803); killer cell immunoglobulin like receptor, two Ig domains and long cytoplasmic tail 3 (KIR2DL3; NCBI Gene ID: 3804); killer cell immunoglobulin like receptor, three Ig domains and long cytoplasmic tail 1 (KIR3DL1, KIR, CD158E1; NCBI Gene ID: 3811) (e.g., Lirilumab (IPH2102/BMS-986015), IPH-4102) and Hematopoietic Progenitor Kinase 1 (HPK1, MAP4K1).

In various embodiments, the one or more multi-specific antigen binding molecules described herein are combined or co-administered with one or more blockers or inhibitors of one or more T-cell inhibitory immune checkpoint proteins or receptors. Illustrative T-cell inhibitory immune checkpoint proteins or receptors include without limitation CD274 (CD274, PDL1, PD-L1); programmed cell death 1 ligand 2 (PDCD1LG2, PD-L2, CD273); programmed cell death 1 (PDCD1, PD1, PD-1); cytotoxic T-lymphocyte associated protein 4 (CTLA4, CD152); CD276 (B7H3); V-set domain containing T cell activation inhibitor 1 (VTCN1, B7H4); V-set immunoregulatory receptor (VSIR, B7H5, VISTA); immunoglobulin superfamily member 11 (IGSF11, VSIG3); TNFRSF14 (HVEM, CD270), TNFSF14 (HVEML); CD272 (B and T lymphocyte associated (BTLA)); PVR related immunoglobulin domain containing (PVRIG, CD112R); T cell immunoreceptor with Ig and ITIM domains (TIGIT); lymphocyte activating 3 (LAG3, CD223); hepatitis A virus cellular receptor 2 (HAVCR2, TIMD3, TIM3); galectin 9 (LGALS9); killer cell immunoglobulin like receptor, three Ig domains and long cytoplasmic tail 1 (KIR, CD158E1); killer cell immunoglobulin like receptor, two Ig domains and long cytoplasmic tail 1 (KIR2DL1); killer cell immunoglobulin like receptor, two Ig domains and long cytoplasmic tail 2 (KIR2DL2); killer cell immunoglobulin like receptor, two Ig domains and long cytoplasmic tail 3 (KIR2DL3); and killer cell immunoglobulin like receptor, three Ig domains and long cytoplasmic tail 1 (KIR3DL1). In various embodiments, the one or more multi-specific antigen binding molecules, as described herein, are combined or co-administered with one or more agonist or activators of one or more T-cell stimulatory immune checkpoint proteins or receptors. Illustrative T-cell stimulatory immune checkpoint proteins or receptors include without limitation CD27, CD70; CD40, CD40LG; inducible T cell costimulator (ICOS, CD278); inducible T cell costimulator ligand (ICOSLG, B7H2); TNF receptor superfamily member 4 (TNFRSF4, OX40); TNF superfamily member 4 (TNFSF4, OX40L); TNFRSF9 (CD137), TNFSF9 (CD137L); TNFRSF18 (GITR), TNFSF18 (GITRL); CD80 (B7-1), CD28; nectin cell adhesion molecule 2 (NECTIN2, CD112); CD226 (DNAM-1); CD244 (2B4, SLAMF4), Poliovirus receptor (PVR) cell adhesion molecule (PVR, CD155). See, e.g., Xu, et al., J Exp Clin Cancer Res. (2018) 37:110.

In various embodiments, the one or more multi-specific antigen binding molecules described herein are combined or co-administered with one or more blockers or inhibitors of one or more NK-cell inhibitory immune checkpoint proteins or receptors. Illustrative NK-cell inhibitory immune checkpoint proteins or receptors include without limitation killer cell immunoglobulin like receptor, three Ig domains and long cytoplasmic tail 1 (KIR, CD158E1); killer cell immunoglobulin like receptor, two Ig domains and long cytoplasmic tail 1 (KIR2DL1); killer cell immunoglobulin like receptor, two Ig domains and long cytoplasmic tail 2 (KIR2DL2); killer cell immunoglobulin like receptor, two Ig domains and long cytoplasmic tail 3 (KIR2DL3); killer cell immunoglobulin like receptor, three Ig domains and long cytoplasmic tail 1 (KIR3DL1); killer cell lectin like receptor C1 (KLRC1, NKG2A, CD159A); and killer cell lectin like receptor D1 (KLRD1, CD94). In various embodiments, the one or more multi-specific antigen binding molecules, as described herein, are combined or co-administered with one or more agonist or activators of one or more NK-cell stimulatory immune checkpoint proteins or receptors. Illustrative NK-cell stimulatory immune checkpoint proteins or receptors include without limitation CD16, CD226 (DNAM-1); CD244 (2B4, SLAMF4); killer cell lectin like receptor K1 (KLRK1, NKG2D, CD314); SLAM family member 7 (SLAMF7). See, e.g., Davis, et al., Semin Immunol. (2017) 31:64-75; Fang, et al., Semin Immunol. (2017) 31:37-54; and Chiossone, et al., Nat Rev Immunol. (2018) 18(11):671-688.

In some embodiments, the one or more immune checkpoint inhibitors comprises a proteinaceous (e.g., antibody or fragment thereof, or antibody mimetic) inhibitor of PD-L1 (CD274), PD-1 (PDCD1) or CTLA4. In some embodiments, the one or more immune checkpoint inhibitors comprises a small organic molecule inhibitor of PD-L1 (CD274), PD-1 (PDCD1) or CTLA4.

Examples of inhibitors of CTLA4 that can be co-administered include without limitation ipilimumab, tremelimumab, BMS-986218, AGEN1181, AGEN1884, BMS-986249, MK-1308, REGN-4659, ADU-1604, CS-1002, BCD-145, APL-509, JS-007, BA-3071, ONC-392, AGEN-2041, JHL-1155, KN-044, CG-0161, ATOR-1144, PBI-5D3H5, BPI-002, as well as multi-specific inhibitors FPT-155 (CTLA4/PD-L1/CD28), PF-06936308 (PD-1/CTLA4), MGD-019 (PD-1/CTLA4), KN-046 (PD-1/CTLA4), MEDI-5752 (CTLA4/PD-1), XmAb-20717 (PD-1/CTLA4), and AK-104 (CTLA4/PD-1).

Examples of inhibitors of PD-L1 (CD274) or PD-1 (PDCD1) that can be co-administered include without limitation pembrolizumab, nivolumab, cemiplimab, pidilizumab, AMP-224, MEDI0680 (AMP-514), spartalizumab, atezolizumab, avelumab, durvalumab, BMS-936559, CK-301, PF-06801591, BGB-A317 (tislelizumab), GLS- 010 (WBP-3055), AK-103 (HX-008), AK-105, CS-1003, HLX-10, MGA-012, BI-754091, AGEN-2034, JS-001 (toripalimab), JNJ-63723283, genolimzumab (CBT-501), LZM-009, BCD-100, LY-3300054, SHR-1201, SHR-1210 (camrelizumab), Sym-021, ABBV-181 (budigalimab), PD1-PIK, BAT-1306, (MSB0010718C), CX-072, CBT-502, TSR-042 (dostarlimab), MSB-2311, JTX-4014, BGB-A333, SHR-1316, CS-1001 (WBP-3155, KN-035, IBI-308 (sintilimab), HLX-20, KL-A167, STI-A1014, STI-A1015 (IMC-001), BCD-135, FAZ-053, TQB-2450, MDX1105-01, GS-4224, GS-4416, INCB086550, MAX10181, as well as multi-specific inhibitors FPT-155 (CTLA4/PD-L1/CD28), PF-06936308 (PD-1/CTLA4), MGD-013 (PD-1/LAG-3), FS-118 (LAG-3/PD-L1) MGD-019 (PD-1/CTLA4), KN-046 (PD-1/CTLA4), MEDI-5752 (CTLA4/PD-1), RO-7121661 (PD-1/TIM-3), XmAb-20717 (PD-1/CTLA4), AK-104 (CTLA4/PD-1), M7824 (PD-L1/TGFβ-EC domain), CA-170 (PD-L1/VISTA), CDX-527 (CD27/PD-L1), LY-3415244 (TIM3/PDL1), and INBRX-105 (4-1BB/PDL1).

In some embodiments, the small molecule inhibitor of CD274 or PDCD1 is selected from the group consisting of GS-4224, GS-4416, INCB086550 and MAX10181. In some embodiments, the small molecule inhibitor of CTLA4 comprises BPI-002.

Inhibitors of T cell immunoreceptor with Ig and ITIM domains (TIGIT)

In various embodiments, the immunogenic polypeptides, polynucleotides encoding such polypeptides, vectors, LNPs and immunogenic compositions comprising such polypeptides or polynucleotides, as described herein, are combined or co-administered with one or more inhibitors of T cell immunoreceptor with Ig and ITIM domains (TIGIT) (NCBI Gene ID: 201633). Example anti-TIGIT antibodies, that can be combined or co-administered include etigilimab, BMS-986207, tiragolumab (a.k.a., MTIG-7192A; RG-6058; RO 7092284), vibostolimab (MK-7684), ociperlimab (BGB-A1217), domvanalimab (AB154), AGEN1307, AGEN1327, AGEN1777, COM-902, IBI-939, AB154, SGN-TGT, MG1131 and EOS884448 (EOS-448).

TNF Receptor Superfamily (TNFRSF) Member Agonists or Activators

In various embodiments, the one or more multi-specific antigen binding molecules described herein are combined or co-administered with an agonist of one or more TNF receptor superfamily (TNFRSF) members, e.g., an agonist of one or more of TNFRSF1A (NCBI Gene ID: 7132), TNFRSF1B (NCBI Gene ID: 7133), TNFRSF4 (OX40, CD134; NCBI Gene ID: 7293), TNFRSF5 (CD40; NCBI Gene ID: 958), TNFRSF6 (FAS, NCBI Gene ID: 355), TNFRSF7 (CD27, NCBI Gene ID: 939), TNFRSF8 (CD30, NCBI Gene ID: 943), TNFRSF9 (4-1BB, CD137, NCBI Gene ID: 3604), TNFRSF10A (CD261, DR4, TRAILR1, NCBI Gene ID: 8797), TNFRSF10B (CD262, DR5, TRAILR2, NCBI Gene ID: 8795), TNFRSF10C (CD263, TRAILR3, NCBI Gene ID: 8794), TNFRSF10D (CD264, TRAILR4, NCBI Gene ID: 8793), TNFRSF11A (CD265, RANK, NCBI Gene ID: 8792), TNFRSF11B (NCBI Gene ID: 4982), TNFRSF12A (CD266, NCBI Gene ID: 51330), TNFRSF13B (CD267, NCBI Gene ID: 23495), TNFRSF13C (CD268, NCBI Gene ID: 115650), TNFRSF16 (NGFR, CD271, NCBI Gene ID: 4804), TNFRSF17 (BCMA, CD269, NCBI Gene ID: 608), TNFRSF18 (GITR, CD357, NCBI Gene ID: 8784), TNFRSF19 (NCBI Gene ID: 55504), TNFRSF21 (CD358, DR6, NCBI Gene ID: 27242), and TNFRSF25 (DR3, NCBI Gene ID: 8718).

Example anti-TNFRSF4 (OX40) antibodies that can be co-administered include without limitation, MEDI6469, MEDI6383, MEDI0562 (tavolixizumab), MOXR0916, PF-04518600, RG-7888, GSK-3174998, INCAGN1949, BMS-986178, GBR-8383, ABBV-368, and those described in WO2016179517, WO2017096179, WO2017096182, WO2017096281, and WO2018089628.

Example anti-TNFRSF5 (CD40) antibodies that can be co-administered include without limitation RG7876, SEA-CD40, APX-005M and ABBV-428.

In some embodiments, the anti-TNFRSF7 (CD27) antibody varlilumab (CDX-1127) is co-administered.

Example anti-TNFRSF9 (4-1BB, CD137) antibodies that can be co-administered include without limitation urelumab, utomilumab (PF-05082566), AGEN2373 and ADG-106.

Example anti-TNFRSF18 (GITR) antibodies that can be co-administered include without limitation, MEDI1873, FPA-154, INCAGN-1876, TRX-518, BMS-986156, MK-1248, GWN-323, and those described in WO2017096179, WO2017096276, WO2017096189, and WO2018089628. In some embodiments, an antibody, or fragment thereof, co-targeting TNFRSF4 (OX40) and TNFRSF18 (GITR) is co-administered. Such antibodies are described, e.g., in WO2017096179 and WO2018089628.

Bi- and Tri-Specific Natural Killer (NK)-Cell Engagers

In various embodiments, the one or more multi-specific antigen binding molecules described herein are combined or co-administered with a bi-specific NK-cell engager (BiKE) or a tri-specific NK-cell engager (TriKE) (e.g., not having an Fc) or bi-specific antibody (e.g., having an Fc) against an NK cell activating receptor, e.g., CD16A, C-type lectin receptors (CD94/NKG2C, NKG2D, NKG2E/H and NKG2F), natural cytotoxicity receptors (NKp30, NKp44 and NKp46), killer cell C-type lectin-like receptor (NKp65, NKp80), Fc receptor FcγR (which mediates antibody-dependent cell cytotoxicity), SLAM family receptors (e.g., 2B4, SLAM6 and SLAM7), killer cell immunoglobulin-like receptors (KIR) (KIR-2D5 and KIR-3D5), DNAM-1 and CD137 (4-1BB). Illustrative anti-CD16 bi-specific antibodies, BiKEs or TriKEs that can be co-administered include AFM26 (BCMA/CD16A) and AFM-13 (CD16/CD30). As appropriate, the anti-CD16 binding bi-specific molecules may or may not have an Fc. BiKEs and TriKEs are described, e.g., in Felices, et al., Methods Mol Biol. (2016) 1441:333-346; Fang, et al., Semin Immunol. (2017) 31:37-54. Examples of a trispecific NK cell engager (TRiKE) include OXS-3550, HIV-TriKE, and CD16-IL-15-B7H3 TriKe.

Phosphatidylinositol 3-kinase (PI3K) Inhibitors

In certain embodiments, the one or more multi-specific antigen binding molecules described herein are combined or co-administered with an inhibitor of at least one of a phosphatidylinositol-4,5-bisphosphate 3-kinase catalytic subunit, e.g., phosphatidylinositol-4,5-bisphosphate 3-kinase catalytic subunit alpha (PIK3CA, CLAPO, CLOVE, CWS5, MCAP, MCM, MCMTC, PI3K, PI3K-alpha, p110-alpha; NCBI Gene ID: 5290); phosphatidylinositol-4,5-bisphosphate 3-kinase catalytic subunit beta (PIK3CB, P110BETA, PI3K, PI3KBETA, PIK3C1; NCBI Gene ID: 5291); phosphatidylinositol-4,5-bisphosphate 3-kinase catalytic subunit gamma (PIK3CG, PI3CG, PI3K, PI3Kgamma, PIK3, p110gamma, p120-PI3K; Gene ID: 5494); and phosphatidylinositol-4,5-bisphosphate 3-kinase catalytic subunit delta (PIK3CD, APDS, IMD14, P110DELTA, PI3K, p110D, NCBI Gene ID: 5293). In some embodiments, the PI3K inhibitor is a pan-PI3K inhibitor. Examples of PI3K inhibitors that can be combined or co-administered include without limitation, ACP-319, AEZA-129, AMG-319, AS252424, AZD8186, BAY 1082439, BEZ235, bimiralisib (PQR309), buparlisib (BKM120), BYL719 (alpelisib), carboxyamidotriazole orotate (CTO), CH5132799, CLR-457, CLR-1401, copanlisib (BAY 80-6946), DS-7423, duvelisib (IPI-145), fimepinostat (CUDC-907), gedatolisib (PF-05212384), GDC-0032, GDC-0084 (RG7666), GDC-0077, pictilisib (GDC-0941), GDC-0980, GSK2636771, GSK2269577, idelalisib (Zydelig®), INCB040093, INCB50465, IPI-443, IPI-549, KAR4141, LY294002, LY3023414, NERLYNX® (neratinib), nemiralisib (GSK2269557), omipalisib (GSK2126458, GSK458), OXY111A, panulisib (P7170, AK151761), PA799, perifosine (KRX-0401), Pilaralisib (SAR245408; XL147), puquitinib mesylate (XC-302), SAR260301, seletalisib (UCB-5857), serabelisib (INK-1117, MLN-1117, TAK-117), SF1126, sonolisib (PX-866), RG7604, rigosertib sodium (ON-01910 sodium), RP5090, tenalisib (RP6530), RV-1729, SRX3177, taselisib, TG100115, umbralisib (TGR-1202), TGX221, voxtalisib (SAR245409), VS-5584, WX-037, X-339, X-414, XL499, XL756, wortmannin, ZSTK474, and the compounds described in WO 2005/113556 (ICOS), WO 2013/052699 (Gilead Calistoga), WO 2013/116562 (Gilead Calistoga), WO 2014/100765 (Gilead Calistoga), WO 2014/100767 (Gilead Calistoga), and WO 2014/201409 (Gilead Sciences).

Alpha-4/Beta-7 Antagonists

In certain embodiments, the one or more multi-specific antigen binding molecules described herein are combined or co-administered with an alpha-4/beta-7 antagonist. Examples of Integrin alpha-4/beta-7 antagonists include PTG-100, TRK-170, abrilumab, etrolizumab, carotegrast methyl, and vedolizumab.

HPK1 Inhibitors

In certain embodiments, the one or more multi-specific antigen binding molecules described herein are combined or co-administered with an inhibitor of mitogen-activated protein kinase kinase kinase kinase 1 (MAP4K1; NCBI Gene ID: 11184; a.k.a., Hematopoietic Progenitor Kinase 1 (HPK1)). Examples of HPK1 inhibitors include, but are not limited to, ZYF-0272, and ZYF-0057.

Pharmacokinetic Enhancers

In certain embodiments, the one or more multi-specific antigen binding molecules described herein are combined or co-administered with a pharmacokinetic enhancer. Examples of pharmacokinetic enhancers include cobicistat and ritonavir.

Additional Therapeutic Agents

Examples of additional therapeutic agents include the compounds disclosed in WO 2004/096286 (Gilead Sciences); WO 2006/015261 (Gilead Sciences); WO 2006/110157 (Gilead Sciences); WO 2012/003497 (Gilead Sciences); WO 2012/003498 (Gilead Sciences); WO 2012/145728 (Gilead Sciences); WO 2013/006738 (Gilead Sciences); WO 2013/159064 (Gilead Sciences); WO 2014/100323 (Gilead Sciences), US 2013/0165489 (University of Pennsylvania), US 2014/0221378 (Japan Tobacco), US 2014/0221380 (Japan Tobacco); WO 2009/062285 (Boehringer Ingelheim); WO 2010/130034 (Boehringer Ingelheim); WO 2013/006792 (Pharma Resources), US 20140221356 (Gilead Sciences), US 20100143301 (Gilead Sciences) and WO 2013/091096 (Boehringer Ingelheim).

Long-Acting HIV Inhibitors

In some embodiments, the one or more multi-specific antigen binding molecules described herein can be co-administered with a long-acting HIV inhibitor. Examples of drugs that are being developed as long acting HIV inhibitors include without limitation: cabotegravir LA, rilpivirine LA, any integrase LA, VM-1500 LAI, maraviroc (LAI), tenofovir implant, islatravir (MK-8591) implant, long-acting dolutegravir.

HIV Vaccines

In certain embodiments, the one or more multi-specific antigen binding molecules described herein are combined or co-administered with an HIV vaccine. Examples of HIV vaccines that can be combined with an agent of this disclosure include peptide vaccines, recombinant subunit protein vaccines, live vector vaccines, DNA vaccines, HIV MAG DNA vaccine, CD4-derived peptide vaccines, vaccine combinations, adenoviral vector vaccines (an adenoviral vector such as Ad5, Ad26 or Ad35), simian adenovirus (chimpanzee, gorilla, rhesus, i.e., rhAd), adeno-associated virus vector vaccines, Chimpanzee adenoviral vaccines (e.g., ChAdOX1, ChAd68, ChAd3, ChAd63, ChAd83, ChAd155, ChAd157, Pan5, Pan6, Pan7, Pan9), Coxsackieviruses based vaccines, enteric virus based vaccines, Gorilla adenovirus vaccines, lentiviral vector based vaccine, arenavirus vaccines (such as LCMV, Pichinde), bi-segmented or tri-segmented arenavirus based vaccine, trimer-based HIV-1 vaccine, measles virus based vaccine, flavivirus vector based vaccines, tobacco mosaic virus vector based vaccine, Varicella-zoster virus based vaccine, Human parainfluenza virus 3 (PIV3) based vaccines, poxvirus based vaccine (modified vaccinia virus Ankara (MVA)), orthopoxvirus-derived NYVAC, and avipoxvirus-derived ALVAC (canarypox virus) strains); fowlpox virus based vaccine, rhabdovirus-based vaccines, such as VSV and marabavirus; recombinant human CMV (rhCMV) based vaccine, alphavirus-based vaccines, such as Semliki forest virus, Venezuelan equine encephalitis virus and sindbis virus (see, e.g., Lauer, et al., *Clin Vaccine Immunol* (2017) 24(1):e00298-16); LNP formulated mRNA based therapeutic vaccines; LNP-formulated self-replicating RNA/self-amplifying RNA vaccines.

Examples of vaccines include: AAVLP-HIV vaccine, anti-CD40.Env-gp140 vaccine, Ad4-EnvC150, BG505 SOSIP.664 gp140 adjuvanted vaccine, BG505 SOSIP.GT1.1 gp140 adjuvanted vaccine, ChAdOx1.tHIVconsv1 vaccine, CMV-MVA triplex vaccine, ChAdOx1.HTI, Chimigen HIV vaccine, ConM SOSIP.v7 gp140, rgp120 (AIDSVAX), ALVAC HIV (vCP1521)/AIDSVAX B/E (gp120) (RV144), monomeric gp120 HIV-1 subtype C vaccine, MPER-656 liposome subunit vaccine, Remune, ITV-1, Contre Vir, Ad5-ENVA-48, DCVax-001 (CDX-2401), Vacc-4x, Vacc-05, VAC-3S, multiclade DNA recombinant adenovirus-5 (rAd5), rAd5 gag-pol env A/B/C vaccine, Pennvax-G, Pennvax-GP, Pennvax-G/MVA-CMDR, HIV-TriMix-mRNA vaccine, HIV-LAMP-vax, Ad35, Ad35-GRIN, NAcGM3/VSSP ISA-51, poly-ICLC adjuvanted vaccines, TatImmune, GTU-multiHIV (FIT-06), ChAdV63.HIVconsv, gp140 [delta]V2.TV1+MF-59, rVSVIN HIV-1 gag vaccine, SeV-EnvF, SeV-Gag vaccine, AT-20, DNK-4, ad35-Grin/ENV, TBC-M4, HIVAX, HIVAX-2, N123-VRC-34.01 inducing epitope-based HIV vaccine, NYVAC-HIV-PT1, NYVAC-HIV-PT4, DNA-HIV-PT123, rAAV1-PG9DP, GOVX-B11, GOVX-B21, GOVX-055, TVI-HIV-1, Ad-4 (Ad4-env Clade C+Ad4-mGag), Paxvax, EN41-UGR7C, EN41-FPA2, ENOB-HV-11, PreVaxTat, AE-H, MYM-V101, CombiHIVvac, ADVAX, MYM-V201, MVA-CMDR, MagaVax, DNA-Ad5 gag/pol/nef/nev (HVTN505), MVATG-17401, ETV-01, CDX-1401, DNA and Sev vectors vaccine expressing SCaVII, rcAD26.MOS1.HIV-Env, Ad26.Mod.HIV vaccine, Ad26.Mod.HIV+MVA mosaic vaccine+gp140, AGS-004, AVX-101, AVX-201, PEP-6409, SAV-001, ThV-01, TL-01, TUTI-16, VGX-3300, VIR-1111, IHV-001, and virus-like particle vaccines such as pseudovirion vaccine, CombiVICHvac, LFn-p24 B/C fusion vaccine, GTU-based DNA vaccine, HIV gag/pol/nef/env DNA vaccine, anti-TAT HIV vaccine, conjugate polypeptides vaccine, dendritic-cell vaccines (such as DermaVir), gag-based DNA vaccine, GI-2010, gp41 HIV-1 vaccine, HIV vaccine (PIKA adjuvant), i-key/MHC class II epitope hybrid peptide vaccines, ITV-2, ITV-3, ITV-4, LIPO-5, multiclade Env vaccine, MVA vaccine, Pennvax-GP, pp71-deficient HCMV vector HIV gag vaccine, rgp160 HIV vaccine, RNActive HIV vaccine, SCB-703, Tat Oyi vaccine, TBC-M4, UBI HIV gp120, Vacc-4x+romidepsin, variant gp120 polypeptide vaccine, rAd5 gag-pol env A/B/C vaccine, DNA.HTI and MVA.HTI, VRC-HIVDNA016-00-VP+VRC-HIVADV014-00-VP, INO-6145, JNJ-9220, gp145 C.6980; eOD-GT8 60mer based vaccine, PD-201401, env (A, B, C, A/E)/gag (C) DNA Vaccine, gp120 (A,B,C,A/E) protein vaccine, PDPHV-201401, Ad4-EnvCN54, EnvSeq-1 Envs HIV-1 vaccine (GLA-SE adjuvanted), HIV p24gag prime-boost plasmid DNA vaccine, HIV-1 iglb12 neutralizing VRC-01 antibody-stimulating anti-CD4 vaccine, arenavirus vector-based vaccines (Vaxwave, TheraT), MVA-BN HIV-1 vaccine regimen, UBI HIV gp120, mRNA based prophylactic vaccines, VPI-211, TBL-1203HI, CH505 TF chTrimer, CD40.HIVRI.Env vaccine, Drep-HIV-PT-1, mRNA-1644, and mRNA-1574.

Birth Control (Contraceptive) Combination Therapy

In certain embodiments, the one or more multi-specific antigen binding molecules described herein are combined or co-administered with a birth control or contraceptive regimen. Therapeutic agents used for birth control (contraceptive) include cyproterone acetate, desogestrel, dienogest, drospirenone, estradiol valerate, ethinyl Estradiol, ethynodiol, etonogestrel, levomefolate, levonorgestrel, lynestrenol, medroxyprogesterone acetate, mestranol, mifepristone, misoprostol, nomegestrol acetate, norelgestromin, norethindrone, noretynodrel, norgestimate, ormeloxifene, segestersone acetate, ulipristal acetate, and any combinations thereof.

Gene Therapy and Cell Therapy

In certain embodiments, the one or more multi-specific antigen binding molecules described herein are combined or co-administered with a gene or cell therapy regimen. Gene therapy and cell therapy include without limitation the genetic modification to silence a gene; genetic approaches to directly kill the infected cells; the infusion of immune cells designed to replace most of the patient's own immune system to enhance the immune response to infected cells, or activate the patient's own immune system to kill infected cells, or find and kill the infected cells; genetic approaches to modify cellular activity to further alter endogenous immune responsiveness against the infection. Examples of cell therapy include LB-1903, ENOB-HV-01, ENOB-HV-21, ENOB-HV-31, GOVX-B01, HSPCs overexpressing ALDH1 (LV-800, HIV infection), AGT103-T, and SupT1 cell-based therapy. Examples of dendritic cell therapy include AGS-004. CCR5 gene editing agents include SB-728T. CCR5 gene inhibitors include Cal-1, and lentivirus vector CCR5 shRNA/TRIM5alpha/TAR decoy-transduced autologous CD34-positive hematopoietic progenitor cells (HIV infection/HIV-related lymphoma). In some embodiments, C34-CCR5/C34-CXCR4 expressing CD4-positive T-cells are co-administered with one or more multi-specific antigen binding molecules. In some embodiments, the agents described herein are co-administered with AGT-103-transduced autologous T-cell therapy or AAV-eCD4-Ig gene therapy.

Gene Editors

In certain embodiments, the one or more multi-specific antigen binding molecules described herein are combined or co-administered with a gene editor, e.g., an HIV targeted gene editor. In various embodiments, the genome editing system can be selected from the group consisting of: a CRISPR/Cas9 complex, a zinc finger nuclease complex, a TALEN complex, a homing endonucleases complex, and a meganuclease complex. An illustrative HIV targeting CRISPR/Cas9 system includes without limitation EBT-101.

CAR-T-Cell Therapy

In some embodiments, the one or more multi-specific antigen binding molecules described herein can be co-administered with a population of immune effector cells engineered to express a chimeric antigen receptor (CAR), wherein the CAR comprises an HIV antigen binding domain. The HIV antigen includes an HIV envelope protein or a portion thereof, gp120 or a portion thereof, a CD4 binding site on gp120, the CD4-induced binding site on gp120, N glycan on gp120, the V2 of gp120, the membrane proximal region on gp41. The immune effector cell is a T-cell or an NK cell. In some embodiments, the T-cell is a CD4+ T-cell, a CD8+ T-cell, or a combination thereof. Cells can be autologous or allogeneic. Examples of HIV CAR-T include convertible CAR-T, VC-CAR-T, CMV-N6-CART, anti-CD4 CART-cell therapy, CD4 CAR+C34-CXCR4+CCR5 ZFN T-cells, dual anti-CD4 CART-T cell therapy (CD4 CAR+C34-CXCR4 T-cells), anti-CD4 MicAbody antibody+anti-MicAbody CAR T-cell therapy (iNKG2D CAR, HIV infection), GP-120 CAR-T therapy, autologous hematopoietic stem cells genetically engineered to express a CD4 CAR and the C46 peptide.

TCR-T-Cell Therapy

In certain embodiments, the one or more multi-specific antigen binding molecules described herein are combined or co-administered with a population of TCR-T-cells. TCR-T-cells are engineered to target HIV derived peptides present on the surface of virus-infected cells, for example ImmTAV.

B-Cell Therapy

In certain embodiments, the one or more multi-specific antigen binding molecules described herein are combined or co-administered with a population of B cells genetically modified to express broadly neutralizing antibodies, such as 3BNC117 (Hartweger, et al, *J. Exp. Med.* (2019) 1301, Moffett, et al., *Sci. Immunol.* 4, eaax0644 (2019) 17 May 2019).

Illustrative Combination Therapies

In some embodiments, the one or more multi-specific antigen binding molecules described herein are combined or co-administered with one, two, three, four or more additional therapeutic agents selected from ATRIPLA® (efavirenz, tenofovir disoproxil fumarate, and emtricitabine); COMPLERA® (EVIPLERA®; rilpivirine, tenofovir disoproxil fumarate, and emtricitabine); STRIBILD® (elvitegravir, cobicistat, tenofovir disoproxil fumarate, and emtricitabine); TRUVADA® (tenofovir disoproxil fumarate and emtricitabine; TDF+FTC); DESCOVY® (tenofovir alafenamide and emtricitabine); ODEFSEY® (tenofovir alafenamide, emtricitabine, and rilpivirine); GENVOYA® (tenofovir alafenamide, emtricitabine, cobicistat, and elvitegravir); BIKTARVY® (bictegravir+emtricitabine+tenofovir alafenamide), adefovir; adefovir dipivoxil; cobicistat; emtricitabine; tenofovir; tenofovir alafenamide and elvitegravir; tenofovir alafenamide+elvitegravir (rectal formulation, HIV infection); tenofovir disoproxil; tenofovir disoproxil fumarate; tenofovir alafenamide; tenofovir alafenamide hemifumarate; TRIUMEQ® (dolutegravir, abacavir, and lamivudine); dolutegravir, abacavir sulfate, and lamivudine; raltegravir; PEGylated raltegravir; raltegravir and lamivudine; maraviroc; tenofovir+emtricitabine+maraviroc, enfuvirtide; ALUVIA® (KALETRA®; lopinavir and ritonavir); COMBIVIR® (zidovudine and lamivudine; AZT+3TC); EPZICOM® (LIVEXA®; abacavir sulfate and lamivudine; ABC+3TC); TRIZIVIR® (abacavir sulfate, zidovudine, and lamivudine; ABC+AZT+3TC); rilpivirine; rilpivirine hydrochloride; atazanavir sulfate and cobicistat; atazanavir and cobicistat; darunavir and cobicistat; atazanavir; atazanavir sulfate; dolutegravir; elvitegravir; ritonavir; atazanavir sulfate and ritonavir; darunavir; lamivudine; prolastin; fosamprenavir; fosamprenavir calcium efavirenz; etravirine; nelfinavir; nelfinavir mesylate; interferon; didanosine; stavudine; indinavir; indinavir sulfate; tenofovir and lamivudine; zidovudine; nevirapine; saquinavir; saquinavir mesylate; aldesleukin; zalcitabine; tipranavir; amprenavir; delavirdine; delavirdine mesylate; Radha-108 (receptol); lamivudine and tenofovir disoproxil fumarate; efavirenz, lamivudine, and tenofovir disoproxil fumarate; phosphazid; lamivudine, nevirapine, and zidovudine; abacavir; and abacavir sulfate.

In some embodiments, the one or more multi-specific antigen binding molecules described herein are combined or co-administered with an HIV nucleoside or nucleotide inhibitor of reverse transcriptase and an HIV non-nucleoside inhibitor of reverse transcriptase. In another specific embodiment, the one or more multi-specific antigen binding molecules described herein, or a pharmaceutical composition thereof, is combined or co-administered with an HIV nucleoside or nucleotide inhibitor of reverse transcriptase, and an HIV protease inhibiting compound. In an additional embodiment, the one or more multi-specific antigen binding molecules described herein, or a pharmaceutical composition thereof, is combined or co-administered with an HIV nucleoside or nucleotide inhibitor of reverse transcriptase, an HIV non-nucleoside inhibitor of reverse transcriptase, and a pharmacokinetic enhancer. In certain embodiments, the one or more multi-specific antigen binding molecules described herein, or a pharmaceutical composition thereof, is combined or co-administered with at least one HIV nucleoside inhibitor of reverse transcriptase, an integrase inhibitor, and a pharmacokinetic enhancer. In another embodiment, the one or more multi-specific antigen binding molecules described herein, or a pharmaceutical composition thereof, is combined or co-administered with two HIV nucleoside or nucleotide inhibitors of reverse transcriptase.

In some embodiments, the one or more multi-specific antigen binding molecules described herein are combined or co-administered with abacavir sulfate, tenofovir, tenofovir disoproxil, tenofovir disoproxil fumarate, tenofovir disoproxil hemifumarate, tenofovir alafenamide, or tenofovir alafenamide hemifumarate.

In some embodiments, the one or more multi-specific antigen binding molecules described herein are combined or co-administered with tenofovir, tenofovir disoproxil, tenofovir disoproxil fumarate, tenofovir alafenamide, or tenofovir alafenamide hemifumarate.

In some embodiments, the one or more multi-specific antigen binding molecules described herein are combined or co-administered with a first additional therapeutic agent selected from the group consisting of abacavir sulfate, tenofovir, tenofovir disoproxil, tenofovir disoproxil fumarate, tenofovir alafenamide, and tenofovir alafenamide hemifumarate, and a second additional therapeutic agent selected from the group consisting of emtricitabine and lamivudine.

In some embodiments, the one or more multi-specific antigen binding molecules described herein are combined or co-administered with a first additional therapeutic agent selected from the group consisting of tenofovir, tenofovir disoproxil, tenofovir disoproxil fumarate, tenofovir alafenamide, and tenofovir alafenamide hemifumarate, and a second additional therapeutic agent, wherein the second additional therapeutic agent is emtricitabine.

In some embodiments, the one or more multi-specific antigen binding molecules described herein are combined or co-administered with a first additional therapeutic agent selected from a first additional therapeutic agent selected from dolutegravir, cabotegravir, islatravir, darunavir, bictegravir, elsulfavirine, rilpivirine, and lenacapavir and a second additional therapeutic agent selected from emtricitabine and lamivudine.

In some embodiments, the one or more multi-specific antigen binding molecules described herein are combined or co-administered with a first additional therapeutic agent (a contraceptive) selected from the group consisting of cyproterone acetate, desogestrel, dienogest, drospirenone, estradiol valerate, ethinyl Estradiol, ethynodiol, etonogestrel, levomefolate, levonorgestrel, lynestrenol, medroxyprogesterone acetate, mestranol, mifepristone, misoprostol, nomegestrol acetate, norelgestromin, norethindrone, noretynodrel, norgestimate, ormeloxifene, segestersone acetate, ulipristal acetate, and any combinations thereof.

In certain embodiments, the one or more multi-specific antigen binding molecules described herein are combined or co-administered with one or more additional therapeutic agents in a therapeutically effective dosage in the amount in the range of e.g., in the range of 0.05 mg to 1000 mg per administration, e.g., from 0.05 mg to 150 mg per administration, e.g., from 0.05 mg to 0.35 mg per administration, e.g., from 25 mg to 50 mg per administration, e.g., from 30 mg to 35 mg per administration, e.g., from 10 mg to 1000 mg per administration, e.g., from 50 mg to 1000 mg per administration, e.g., from 100 mg to 700 mg per administration, e.g., at least 0.05 mg up to 0.1 mg, 0.2 mg, 0.3 mg, 0.35 mg, 0.4 mg, 0.5 mg, 0.6 mg, 0.7 mg, 0.8 mg, 1.0 mg, 5 mg, 10 mg, 25 mg, 30 mg, 35 mg, 40 mg, 45 mg, 50 mg, 60 mg, 70 mg, 80 mg, 90 mg, 100 mg, 200 mg, 300 mg, 400 mg, 500 mg, 600 mg, 700 mg, 800 mg, 900 mg, or 1000 mg per administration of the multi-specific antigen binding molecule. In certain embodiments, the one or more multi-specific antigen binding molecules described herein are combined or co-administered with one or more additional therapeutic agents, the multi-specific antigen binding molecule being administered in a therapeutically effective dosage amount, e.g., in the range of from 1 µg/kg to 5 µg/kg, e.g., from 350 µg/kg to 550 µg/kg, e.g., from 0.3 mg/kg to 30 mg/kg, e.g., from 2 mg/kg to 10 mg/kg, e.g., from 1 µg/kg up to 2 µg/kg, 3 µg/kg, 4 µg/kg, 5 µg/kg, 10 µg/kg, 50 µg/kg, 100 µg/kg, 250 µg/kg, 300 µg/kg, 350 µg/kg, 400 µg/kg, 410 µg/kg, 420 µg/kg, 430 µg/kg, 440 µg/kg, 450 µg/kg, 460 µg/kg, 470 µg/kg, 480 µg/kg, 490 µg/kg, 500 µg/kg, 750 µg/kg, 1 mg/kg, 1.5 mg/kg, 2 mg/kg, 2.5 mg/kg, 3 mg/kg, 3.5 mg/kg, 4 mg/kg, 4.5 mg/kg, 5 mg/kg, 6 mg/kg, 7 mg/kg, 8 mg/kg, 9 mg/kg, 10 mg/kg, 15 mg/kg, 20 mg/kg, 25 mg/kg, 30 mg/kg, 35 mg/kg, 40 mg/kg, 45 mg/kg, or 50 mg/kg, body weight per administration.

In certain embodiments, the one or more multi-specific antigen binding molecules described herein are combined or co-administered with 5-30 mg tenofovir alafenamide fumarate, tenofovir alafenamide hemifumarate, or tenofovir alafenamide, and 200 mg emtricitabine. In certain embodiments, the one or more multi-specific antigen binding molecules described herein are combined or co-administered with 5-10, 5-15, 5-20, 5-25, 25-30, 20-30, 15-30, or 10-30 mg tenofovir alafenamide fumarate, tenofovir alafenamide hemifumarate, or tenofovir alafenamide, and 200 mg emtricitabine. In certain embodiments, the one or more multi-specific antigen binding molecules described herein are combined or co-administered with 10 mg tenofovir alafenamide fumarate, tenofovir alafenamide hemifumarate, or tenofovir alafenamide, and 200 mg emtricitabine. In certain embodiments, the one or more multi-specific antigen binding molecules described herein are combined or co-administered with 25 mg tenofovir alafenamide fumarate, tenofovir alafenamide hemifumarate, or tenofovir alafenamide, and 200 mg emtricitabine. In some embodiments, the one or more multi-specific antigen binding molecules described herein are combined or co-administered with the agents provided herein in any dosage amount of the one or more multi-specific antigen binding molecules (e.g., from 1 mg to 500 mg of the one or more multi-specific antigen binding molecules, as described herein) the same as if each combination of dosages were specifically and individually listed.

In certain embodiments, the one or more multi-specific antigen binding molecules described herein are combined or co-administered with 200-400 mg tenofovir disoproxil fumarate, tenofovir disoproxil hemifumarate, or tenofovir disoproxil, and 200 mg emtricitabine. In certain embodiments, the one or more multi-specific antigen binding molecules described herein are combined or co-administered with 200-250, 200-300, 200-350, 250-350, 250-400, 350-400, 300-400, or 250-400 mg tenofovir disoproxil fumarate, tenofovir disoproxil hemifumarate, or tenofovir disoproxil, and 200 mg emtricitabine. In certain embodiments, the one or more multi-specific antigen binding molecules described herein are combined or co-administered with 300 mg tenofovir disoproxil fumarate, tenofovir disoproxil hemifumarate, or tenofovir disoproxil, and 200 mg emtricitabine. The one or more multi-specific antigen binding molecules may be combined with the agents provided herein in any dosage amount (e.g., from 1 mg to 500 mg of the one or more multi-specific antigen binding molecules) the same as if each combination of dosages were specifically and individually listed.

11. Pharmaceutical Compositions

Further provided are pharmaceutical compositions comprising one or more (e.g., one, two or three) multi-specific antigen binding molecules, as described herein, or one or more polynucleotide encoding one or more multi-specific antigen binding molecules, as described herein, and a pharmaceutically acceptable diluent, carrier or excipient. In certain embodiments, the pharmaceutical composition comprises a therapeutically effective amount of one or more unitary doses of one or more multi-specific antigen binding molecules, or one or more polynucleotides encoding the one or more multi-specific antigen binding molecules.

Various pharmaceutically acceptable diluents, carriers, and excipients, and techniques for the preparation and use of pharmaceutical compositions will be known to those of skill in the art in light of the present disclosure. Illustrative pharmaceutical compositions and pharmaceutically acceptable diluents, carriers, and excipients are also described, e.g., in Remington: The *Science* and Practice of Pharmacy 20th Ed. (Lippincott, Williams & Wilkins 2003); Loyd V. Allen Jr (Editor), "Remington: The *Science* and Practice of Pharmacy," $22^{nd}$ Edition, 2012, Pharmaceutical Press; Brunton, Knollman and Hilal-Dandan, "Goodman and Gilman's The Pharmacological Basis of Therapeutics," 13th Edition, 2017, McGraw-Hill Education/Medical; McNally and Hastedt (Editors), "Protein Formulation and Delivery, 2nd Edition, 2007, CRC Press; Banga, "Therapeutic Peptides and Proteins: Formulation, Processing, and Delivery Systems," 3rd Edition, 2015, CRC Press; Lars Hovgaard, Frokjaer and van de Weert (Editors), "Pharmaceutical Formulation Development of Peptides and Proteins," 2nd Edition, 2012, CRC Press; Carpenter and Manning (Editors), "Rational Design of Stable Protein Formulations: Theory and Practice," 2002, Springer (Pharmaceutical Biotechnology (Book 13)); Meyer (Editor), "Therapeutic Protein Drug Products: Practical Approaches to Formulation in the Laboratory, Manufacturing, and the Clinic, 2012, Woodhead Publishing; and Shire, "Monoclonal Antibodies: Meeting the Challenges in Manufacturing, Formulation, Delivery and Stability of Final Drug Product, 2015, Woodhead Publishing.

In some embodiments, each carrier, diluent or excipient is "acceptable" in the sense of being compatible with the other ingredients of the pharmaceutical composition and not injurious to the subject. Often, the pharmaceutically acceptable carrier is an aqueous pH-buffered solution. Some examples of materials which can serve as pharmaceutically-acceptable carriers, diluents or excipients include: water; buffers, e.g., phosphate-buffered saline; sugars, such as lactose, trehalose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; 2-Amino-2-(hydroxymethyl)propane-1,3-diol (i.e., tris(hydroxymethyl)aminomethane; Tris) buffers, amino acids (e.g., charged amino acids, including without limitation, aspartate, asparagine, glutamate, glutamine, histidine, lysine, arginine); and other non-toxic compatible substances employed in pharmaceutical formulations. Wetting agents, emulsifiers and lubricants, such as sodium lauryl sulfate, a polysorbate (e.g., polysorbate 20, polysorbate 40, polysorbate 60, polysorbate 80) and magnesium stearate, as well as coloring agents, release agents, coating agents, sweetening, flavoring and perfuming agents, preservatives and antioxidants can also be present in the compositions. In one embodiment, the pharmaceutical composition comprises a physiologically acceptable buffer, pH 5.5 to 8.5, e.g., pH 5.5 to 6.5, sucrose, and polysorbate 80. In one embodiment, the pharmaceutical composition comprises histidine, sucrose, and polysorbate 80. In one embodiment, the pharmaceutical composition comprises sodium phosphate, sucrose, and polysorbate 80. In one embodiment, the pharmaceutical composition comprises a Tris buffer, sucrose, and polysorbate 80. In certain embodiments, pharmaceutical compositions are sterile. In certain embodiments, the pharmaceutical composition has a pH in the range of 4.5 to 8.5, 5.5 to 7.4, 4.5 to 6.5, 6.4 to 7.0, 6.5 to 8.5, 7.2 to 7.8, or a pH of 5.0, 5.5, 5.6, 5.7, 5.8, 5.9, 6.0, 6.5, 7.0, 7.5, 8.0 or 8.5. In one embodiment, the pharmaceutical composition has an osmolarity in the range of 240-260 or 250-330 mOsmol/L. In certain embodiments, the pharmaceutical composition is isotonic or near isotonic.

The formulation of and delivery methods of pharmaceutical compositions will generally be adapted according to the site and the disease to be treated. Exemplary formulations include, but are not limited to, those suitable for parenteral administration, e.g., intravenous, intra-arterial, intramuscular, or subcutaneous administration, including formulations encapsulated in micelles, liposomes or drug-release capsules (active agents incorporated within a biocompatible coating designed for slow-release); ingestible formulations; formulations for topical use, such as creams, ointments and gels; and other formulations such as inhalants, aerosols and sprays.

In some embodiments, the pharmaceutical compositions are formulated for parenteral, e.g., intravenous, subcutaneous, or intramuscular). In particular embodiments, for parenteral administration, the antibodies or antigen-binding fragments thereof are formulated in a unit dosage injectable form (solution, suspension, emulsion) in association with a pharmaceutically acceptable, parenteral vehicle. Examples of such vehicles include water, saline, Ringer's solution, dextrose solution, and 5% human serum albumin. Nonaqueous vehicles such as fixed oils and ethyl oleate may also be used. Liposomes may be used as carriers. The vehicle may contain minor amounts of additives such as substances that enhance isotonicity and chemical stability, e.g., buffers and preservatives. In certain embodiments, the multi-specific antigen binding molecules are formulated in such vehicles at concentrations of from 0.10 mg/ml to 150 mg/ml, e.g., from 0.11 mg/ml to 100 mg/ml, e.g., from 1 mg/ml to 100 mg/ml, e.g., from 5 mg/ml to 60 mg/ml, e.g., from 20 mg/ml to 150 mg/ml, e.g., from 10 mg/ml to 50 mg/ml, e.g., 5 mg/ml, 10 mg/ml, 15 mg/ml, 20 mg/ml, 25 mg/ml, 30 mg/ml, 35 mg/ml, 40 mg/ml, 45 mg/ml, 50 mg/ml, 60 mg/ml, 70 mg/ml, 80 mg/ml, 90 mg/ml, 100 mg/ml, 125 mg/ml or 150 mg/ml.

In some embodiments, the pharmaceutical composition comprises a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO:746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO:746. In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence of SEQ ID NO:746.

In some embodiments, the pharmaceutical composition comprises first and second antigen binding molecules. In some embodiments, the first multi-specific antigen binding molecule competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second antigen binding molecule or antibody or fragment thereof, competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of GS-9722 (elipovimab), GS-2872, PGT-121, PGT121.414, 10-1074, 10-1074-J and PGT-134, and the second antigen binding molecule or antibody or antigen binding fragment thereof competes with or comprises VH and VL regions from 3BNC117, GS-9723, VRC07 or VRC07-523.

In some embodiments, the first multi-specific antigen binding molecule competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of 3BNC117, GS-9723, VRC07 or VRC07-523, and the second antigen binding molecule or antibody or antigen binding fragment thereof competes with or comprises VH and VL regions from GS-9722 (elipovimab), GS-2872, PGT-121, PGT121.414, 10-1074, 10-1074-J and PGT-134.

In some embodiments, the first multi-specific antigen binding molecule competes with or comprises VH and VL regions from an antibody selected from the group consisting of GS-9722 (elipovimab), GS-2872, PGT-121, PGT121.414, 10-1074, 10-1074-J and PGT-134, and the second antigen binding molecule comprises a soluble extracellular region of CD4 (e.g., domain 1 (D1), D1-D2, D1-D3, D1-D4). In some embodiments, the first multi-specific antigen binding molecule comprises a soluble extracellular region of CD4 (e.g., domain 1 (D1), D1-D2, D1-D3, D1-D4), and the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule comprises a soluble extracellular region of CD4 (e.g., domain 1 (D1), D1-D2, D1-D3, D1-D4), and the second antigen binding molecule or antibody or antigen binding fragment thereof competes with or comprises VH and VL regions from GS-9722 (elipovimab), GS-2872, PGT-121, PGT121.414, 10-1074, 10-1074-J and PGT-134.

In some embodiments, the pharmaceutical composition comprises first, second and third antigen binding molecules. In some embodiments, the pharmaceutical composition comprises a first multi-specific antigen binding molecule and second and third multi-specific antigen binding molecules or antibodies or fragments thereof. In some embodiments, the first multi-specific antigen binding molecule comprises a soluble extracellular region of CD4 (e.g., domain 1 (D1), D1-D2, D1-D3, D1-D4); the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03; and the third multi-specific antigen binding molecule or antibody or fragment thereof, competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule comprises a soluble extracellular region of CD4 (e.g., domain 1 (D1), D1-D2, D1-D3, D1-D4); the second antigen binding molecule or antibody or fragment thereof, competes with or comprises VH and VL regions from an antibody selected from the group consisting of GS-9722 (elipovimab), GS-2872, PGT-121, PGT121.414, 10-1074, 10-1074-J and PGT-134; and the third multi-specific antigen binding molecule or antibody or antigen binding fragment thereof competes with or comprises VH and VL regions from 3BNC117, GS-9723, VRC07 or VRC07-523.

12. Kits

Further provided are kits comprising one or more of the multi-specific antigen binding molecules described herein, including polynucleotides, pharmaceutical compositions and conjugates thereof.

In some embodiments, the kit comprises a multi-specific antigen binding molecule having a first antigen binding domain that binds to CD3, and a second antigen binding domain that binds to an epitope or region of gp120 in the CD4 binding site (CD4bs) and comprises one or more extracellular (EC) domains of CD4, and optionally, an IL-15 receptor agonist. In some embodiments, the one or more EC domains of CD4 comprise a sequence as set forth in SEQ ID NOs: 746-749, or a sequence that is at least 80%, at least 85%, at least 90%, at least 91%, at least 92%, at least 93%, at least 94%, at least 95%, at least 96%, at least 97%, at least 98%, or at least 99% identical to an amino acid sequence of SEQ ID NOs: 746-749 (e.g., SEQ ID NO:746). In some embodiments, the EC domain of CD4 comprises a sequence that is at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 746. In some embodiments, the EC domain of CD4 comprises a sequence that is at least 95% identical to the sequence of SEQ ID NO: 746. In some embodiments, the EC domain of CD4 comprises a sequence that is at least 99% identical to the sequence of SEQ ID NO: 746. In some embodiments, the EC domain of CD4 comprises the sequence of SEQ ID NO: 746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 95% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising an amino acid sequence that is at least 99% identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Kabat): SEQ ID NOs: 1, 12, 8, 4, 9 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Chothia): SEQ ID NOs: 17, 18, 23, 20, 24 and 25; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to IMGT): SEQ ID NOs: 28, 29, 32, 31, 24 and 10; and the second antigen binding domain comprises one EC domain of CD4 comprising the amino acid sequence of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 42, 40, 37, 41 and 25; or SEQ ID NOs: 34, 43, 40, 37, 41 and 25; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising an amino acid sequence is at least 95% (e.g., at least 99%) identical to a CD4 EC domain of SEQ ID NO:746. In some embodiments, the first antigen binding domain comprises a first VH-CDR1, a first VH-CDR2, a first VH-CDR3, a first VL-CDR1, a first VL-CDR2 and a first VL-CDR3 comprising the following amino acid sequences, respectively (according to Honegger): SEQ ID NOs: 34, 43, 40, 37, 41 and 25; and the second antigen binding domain comprises one EC domain of CD4 comprising the amino acid sequence of SEQ ID NO:746. In some embodiments, the first antigen binding domain comprises a first VH and a first VL comprising the amino acid sequences set forth, respectively, or comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 49 and 55; SEQ ID NOs: 50 and 55; SEQ ID NOs: 50 and 56; SEQ ID NOs: 51 and 55; or SEQ ID NOs: 51 and 56; and the second antigen binding domain comprises one or more EC domains of CD4 comprising an amino acid sequence that comprises or is at least 80%, at least 85%, at least 90%, at least 91%, at least 92%, at least 93%, at least 94%, at least 95%, at least 96%, at least 97%, at least 98%, or at least 99%, identical to a CD4 EC domain selected from the group consisting of SEQ ID NOs: 746-749 (e.g., SEQ ID NO:746). In some embodiments, the first antigen binding domain comprises a first VH and a first VL comprising amino acid sequences that are at least 80%, at least 85%, at least 90%, at least 91%, at least 92%, at least 93%, at least 94%, at least 95%, at least 96%, at least 97%, at least 98%, or at least 99% identical to the amino acid sequences set forth, respectively: SEQ ID NOs: 51 and 56; and the second antigen binding domain comprises one EC domain of CD4 comprising an amino acid sequence that is at least 80%, at least 85%, at least 90%, at least 91%, at least 92%, at least 93%, at least 94%, at least 95%, at least 96%, at least 97%, at least 98%, or at least 99%, identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 95% identical to the amino acid sequences set forth, respectively: SEQ ID NOs: 51 and 56; and the second antigen binding domain comprises one EC domain of CD4 comprising an amino acid sequence of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising amino acid sequences that are at least 99% identical to the amino acid sequences set forth, respectively: SEQ ID NOs: 51 and 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 95% identical to the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising the amino acid sequence of SEQ ID NO: 51 and a first VL comprising an amino acid sequence that is at least 99% identical to the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 95% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 95% identical to a CD4 EC domain of SEQ ID NO:746. In some embodiments, the first antigen binding domain comprises a first VH comprising an amino acid sequence that is at least 99% identical to the amino acid sequence of SEQ ID NO: 51 and a first VL comprising the amino acid sequence of SEQ ID NO: 56; and the second antigen binding domain comprises one EC domain of CD4 comprising an amino acid sequence that is at least 99% identical to a CD4 EC domain of SEQ ID NO:746. In some embodiments, the first antigen binding domain comprises a first VH and a first VL comprising the amino acid sequences set forth, respectively: SEQ ID NOs: 51 and 56; and the second antigen binding domain comprises one EC domain of CD4 comprising an amino acid sequence of SEQ ID NO:746.

In some embodiments, the kits comprise one or more containers (e.g., vials, ampules) comprising one or more of the multi-specific antigen binding molecules described herein, polynucleotides encoding such multi-specific antigen binding molecules, LNPs or pharmaceutical compositions containing such multi-specific antigen binding molecules.

In one embodiment, kits comprise the one or more multi-specific antigen binding molecules described herein in combination with one or more (e.g., one, two, three, one or two, or one to three) additional therapeutic agents. In some embodiments, the kits comprise one or more unitary doses of the one or more multi-specific antigen binding molecules, or the polynucleotide or polynucleotides, in one or more containers. In some embodiments, the kits comprise one or more unitary doses of the one or more multi-specific antigen binding molecules and a second agent for treating an HIV infection in separate containers.

In some embodiments, the kits further comprise one or more unitary doses of a toll-like receptor (TLR) agonist. In some embodiments, the TLR agonist is a TLR7 agonist or a TLR8 agonist. In some embodiments, the TLR7 agonist is selected from the group consisting of vesatolimod, imiquimod, and resiquimod. In some embodiments, the kits comprise a first multi-specific antigen binding molecule and a second antigen binding molecule or antibody or antigen binding fragment thereof, wherein the first multi-specific antigen binding molecule and a second antigen binding molecule or antibody or antigen binding fragment thereof bind to different first and second epitopes or regions of gp120 selected from the group consisting of: (i) third variable loop (V3) (e.g., high mannose patch) comprising a N332 oligomannose glycan; (ii) second variable loop (V2) (e.g., Env trimer apex); (iii) CD4 binding site (CD4bs); (iv) gp120/gp41 interface; or (v) silent face of gp120. In some embodiments, the first multi-specific antigen binding molecule binds to the third variable loop (V3) (e.g., high mannose patch) comprising a N332 oligomannose glycan and the second antigen binding molecule binds to the CD4 binding site (CD4bs).

In some embodiments, the first multi-specific antigen binding molecule competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03, and the second antigen binding molecule or antibody or fragment thereof, competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule competes with or comprises VH and VL regions from an antibody selected from the group consisting of GS-9722 (elipovimab), GS-2872, PGT-121, PGT121.414, 10-1074, 10-1074-J and PGT-134, and the second antigen binding molecule or antibody or antigen binding fragment thereof competes with or comprises VH and VL regions from 3BNC117, GS-9723, VRC07 or VRC07-523.

In some embodiments, the first multi-specific antigen binding molecule competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25, and the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule competes with or comprises VH and VL regions from an antibody selected from the group consisting of 3BNC117, GS-9723, VRC07 or VRC07-523, and the second antigen binding molecule or antibody or antigen binding fragment thereof competes with or comprises VH and VL regions from GS-9722 (elipovimab), GS-2872, PGT-121, PGT121.414, 10-1074, 10-1074-J and PGT-134.

In some embodiments, the first multi-specific antigen binding molecule competes with or comprises VH and VL regions from an antibody selected from the group consisting of GS-9722 (elipovimab), GS-2872, PGT-121, PGT121.414, 10-1074, 10-1074-J and PGT-134, and the second antigen binding molecule comprises a soluble extracellular region of CD4 (e.g., domain 1 (D1), D1-D2, D1-D3, D1-D4). In some embodiments, the first multi-specific antigen binding molecule comprises a soluble extracellular region of CD4 (e.g., domain 1 (D1), D1-D2, D1-D3, D1-D4), and the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03. In some embodiments, the first multi-specific antigen binding molecule comprises a soluble extracellular region of CD4 (e.g., domain 1 (D1), D1-D2, D1-D3, D1-D4), and the second antigen binding molecule or antibody or antigen binding fragment thereof competes with or comprises VH and VL regions from GS-9722 (elipovimab), GS-2872, PGT-121, PGT121.414, 10-1074, 10-1074-J and PGT-134.

In some embodiments, the kits comprise a first multi-specific antigen binding molecule and second and third multi-specific antigen binding molecules or antibodies or fragments thereof. In some embodiments, the first multi-specific antigen binding molecule comprises a soluble extracellular region of CD4 (e.g., domain 1 (D1), D1-D2, D1-D3, D1-D4); the second antigen binding molecule or antibody or fragment thereof, competes with or comprises VH and VL regions from an antibody selected from the group consisting of GS-9722 (elipovimab), GS-2872, PGT-121, PGT-121.66, PGT-121.414, PGT-122, PGT-123, PGT-124, PGT-125, PGT-126, PGT-128, PGT-130, PGT-133, PGT-134, PGT-135, PGT-136, PGT-137, PGT-138, PGT-139, 10-1074, 10-1074-J, VRC24, 2G12, BG18, 354BG8, 354BG18, 354BG42, 354BG33, 354BG129, 354BG188, 354BG411, 354BG426, DH270.1, DH270.6, PGDM12, VRC41.01, PGDM21, PCDN-33A, BF520.1 and VRC29.03; and the third multi-specific antigen binding molecule or antibody or fragment thereof, competes with or comprises VH and VL regions from an antibody selected from the group consisting of 3BNC117, GS-9723, GS-5423, 3BNC60, b12, F105, VRC01, VRC07, VRC07-523, VRC03, VRC06, VRC06b01 VRC08, VRC0801, NIH45-46, PGV04 (a.k.a., VRC-PG04); CH103, 44-VRC13.01, 1NC9, 12A12, N6, 1-18, N49-P7, NC-Cow1, IOMA, CH235 and CH235.12, N49P6, N49P7, N49P11, N49P9 and N60P25. In some embodiments, the first multi-specific antigen binding molecule comprises a soluble extracellular region of CD4 (e.g., domain 1 (D1), D1-D2, D1-D3, D1-D4); the second antigen binding molecule or antibody or fragment thereof, competes with or comprises VH and VL regions from an antibody selected from the group consisting of GS-9722 (elipovimab), GS-2872, PGT-121, PGT121.414, 10-1074, 10-1074-J and PGT-134; and the third multi-specific antigen binding molecule or antibody or antigen binding fragment thereof competes with or comprises VH and VL regions from 3BNC117, GS-9723, VRC07 or VRC07-523.

In some embodiments, the kits comprise two or more unitary doses of one or more multi-specific antigen binding molecules, and optionally, one or more anti-HIV bNAbs, wherein the unitary doses are the same. In some embodiments, the kits comprise two or more unitary doses of one or more multi-specific antigen binding molecules, and optionally, one or more anti-HIV bNAbs, wherein the unitary doses are different.

In one embodiment, the additional therapeutic agent or agents of the kit is an anti-HIV agent, selected from HIV protease inhibitors, HIV non-nucleoside or non-nucleotide inhibitors of reverse transcriptase, HIV nucleoside or nucleotide inhibitors of reverse transcriptase, HIV integrase inhibitors, HIV non-catalytic site (or allosteric) integrase inhibitors, HIV entry inhibitors, HIV maturation inhibitors, immunomodulators, immunotherapeutic agents, antibody-drug conjugates, gene modifiers, gene editors (such as CRISPR/Cas9, zinc finger nucleases, homing nucleases, synthetic nucleases, TALENs), cell therapies (such as chimeric antigen receptor T-cell, CAR-T, and engineered T cell receptors, TCR-T, autologous T cell therapies), compounds that target the HIV capsid, latency reversing agents, HIV bNAbs, immune-based therapies, phosphatidylinositol 3-kinase (PI3K) inhibitors, HIV antibodies, broadly neutralizing HIV antibodies, bispecific antibodies and "antibody-like" therapeutic proteins, HIV p17 matrix protein inhibitors, IL-13 antagonists, peptidyl-prolyl cis-trans isomerase A modulators, protein disulfide isomerase inhibitors, complement C5a receptor antagonists, DNA methyltransferase inhibitor, HIV vif gene modulators, Vif dimerization antagonists, HIV viral infectivity factor inhibitors, TAT protein inhibitors, HIV Nef modulators, Hck tyrosine kinase modulators, mixed lineage kinase-3 (MLK-3) inhibitors, HIV splicing inhibitors, Rev protein inhibitors, integrin antagonists, nucleoprotein inhibitors, splicing factor modulators, COMM domain containing protein 1 modulators, HIV ribonuclease H inhibitors, retrocyclin modulators, CDK-9 inhibitors, dendritic ICAM-3 grabbing nonintegrin 1 inhibitors, HIV GAG protein inhibitors, HIV POL protein inhibitors, Complement Factor H modulators, ubiquitin ligase inhibitors, deoxycytidine kinase inhibitors, cyclin dependent kinase inhibitors, proprotein convertase PC9 stimulators, ATP dependent RNA helicase DDX3X inhibitors, reverse transcriptase priming complex inhibitors, G6PD and NADH-oxidase inhibitors, pharmacokinetic enhancers, HIV gene therapy, HIV vaccines, and combinations thereof.

In some embodiments, the additional therapeutic agent or agents of the kit are selected from combination drugs for HIV, other drugs for treating HIV, HIV protease inhibitors, HIV reverse transcriptase inhibitors, HIV integrase inhibitors, HIV non-catalytic site (or allosteric) integrase inhibitors, HIV entry (fusion) inhibitors, HIV maturation inhibitors, latency reversing agents, capsid inhibitors, immune-based therapies, PI3K inhibitors, HIV antibodies, and bispecific antibodies, and "antibody-like" therapeutic proteins, and combinations thereof.

In a specific embodiment, the kit includes a multi-specific antigen binding molecule, polynucleotide encoding or pharmaceutical composition comprising, and an HIV nucleoside or nucleotide inhibitor of reverse transcriptase. In a specific embodiment, the kit includes a multi-specific antigen binding molecule, polynucleotide encoding or pharmaceutical composition comprising, and an HIV nucleoside or nucleotide inhibitor of reverse transcriptase and an HIV non-nucleoside inhibitor of reverse transcriptase. In another specific embodiment, the kit includes a multi-specific antigen binding molecule, polynucleotide encoding or pharmaceutical composition comprising, and an HIV nucleoside or nucleotide inhibitor of reverse transcriptase, and an HIV protease inhibiting compound. In an additional embodiment, the kit includes a multi-specific antigen binding molecule, polynucleotide encoding or pharmaceutical composition comprising, and an HIV nucleoside or nucleotide inhibitor of reverse transcriptase, an HIV non-nucleoside inhibitor of reverse transcriptase, and a pharmacokinetic enhancer. In certain embodiments, the kit includes a multi-specific antigen binding molecule, polynucleotide encoding or pharmaceutical composition comprising, and at least one HIV nucleoside inhibitor of reverse transcriptase, an integrase inhibitor, and a pharmacokinetic enhancer. In another embodiment, the kit includes a multi-specific antigen binding molecule, polynucleotide encoding or pharmaceutical composition comprising, and two HIV nucleoside or nucleotide inhibitors of reverse transcriptase. In a specific embodiment, the kit includes a multi-specific antigen binding molecule, polynucleotide encoding or pharmaceutical composition comprising, and an HIV nucleoside or nucleotide inhibitor of reverse transcriptase and an HIV capsid inhibitor. In a specific embodiment, the kit includes a multi-specific antigen binding molecule, polynucleotide encoding or pharmaceutical composition comprising, and an HIV nucleoside inhibitor of reverse transcriptase and an HIV capsid inhibitor. In a specific embodiment, the kit includes a multi-specific antigen binding molecule, polynucleotide encoding or pharmaceutical composition comprising, and an HIV capsid inhibitor. In a specific embodiment, the kit includes a multi-specific antigen binding molecule, polynucleotide encoding or pharmaceutical composition comprising, and one, two, three or four HIV bNAbs. In a specific embodiment, the kit includes a multi-specific antigen binding molecule, polynucleotide encoding or pharmaceutical composition comprising, and one, two, three or four HIV bNAbs and an HIV capsid inhibitor. In a specific embodiment, the kit includes a multi-specific antigen binding molecule, polynucleotide encoding or pharmaceutical composition comprising, and one, two, three or four HIV bNAbs, an HIV capsid inhibitor, and an HIV nucleoside inhibitor of reverse transcriptase.

In one embodiment, the kit comprises one or more pharmaceutical packs comprising one or more containers (e.g., vials, ampules) containing one or more of the ingredients of the pharmaceutical compositions described herein, such as one or more multi-specific (e.g., bispecific antibodies) provided herein. In some instances, the kits contain a pharmaceutical composition described herein. In one embodiment, kits comprising a multi-specific antigen binding molecule disclosed herein, or a pharmaceutical composition thereof, in combination with one or more (e.g., one, two, three, one or two, or one to three) additional therapeutic agents (such as those disclosed above) are provided.

Optionally associated with such container(s) can be a notice in the form prescribed by a governmental agency regulating the manufacture, use or sale of pharmaceuticals or biological products, which notice reflects approval by the agency of manufacture, use or sale for human administration.

EXAMPLES

The following examples are offered to illustrate, but not to limit the claimed invention.

Example 1

Humanization of Mouse SP34 Variable Domains

Bispecific antibodies, in which one of the antigen binding domains interacts with the human CD3 extracellular domain (referred to as "CD3 bispecific antibodies hereafter") can re-direct CD3+ T-cells to kill target cells expressing a second antigen (e.g., Blinatumomab recruitment of CD3+ T-cells to kill CD19+ B-cells). The anti-CD3 binding domain can be used in a modular fashion to re-direct T-cells to attack cells expressing any target antigen of interest (e.g. tumor antigens or viral antigens). In most cases, the anti-CD3 antibody is selected to be cross-reactive to non-human primate (NHP) CD3, thus facilitating animal efficacy and toxicity studies. These animal studies are of critical importance given the potential for toxicity associated with CD3 engaging bispecific antibodies. However, a review of the literature suggests that current generation anti-CD3 bispecific antibodies suffer from numerous challenges in pre-clinical studies.

A 2017 FDA analysis of investigational new drug (IND) applications for clinical stage CD3 bispecific antibodies found that anti-drug-antibodies (ADA) presented significant pre-clinical challenges for all 10 INDs analyzed (Saber, et al. *Regul. Toxicol. Pharmacol.* (2017) 90:144-152). These high preclinical ADA rates may cause difficulty in conducting and/or interpreting pre-clinical efficacy and toxicity studies. In at least one of the examples analyzed by Saber et al, where clinical data was also available, approximately 60% of patients developed ADA. Although this data is far from definitive, and it is generally accepted that high ADA rates in NHP do not correlate with high ADA rates in humans (van Meer, et al. *mAbs* (2013) 5:810-816), these results suggest that prior to the present disclosure, there did not exist anti-CD3 antibodies with low immunogenicity in both NHPs and humans in order to facilitate both the pre-clinical and clinical study of CD3 bispecific antibodies for the treatment of human diseases. This may be particularly important outside of heme malignancies (e.g. solid tumors, infectious disease) where elimination of the target cell type (e.g. B-cells) can often limit the host immune response and reduce or eliminate the negative impacts of ADA. Further, it is not feasible to implement a high dose strategy in toxicology studies for immune activating biologics in NHP where ADA is observed, where a high dose overcomes the ADA (e.g., "dosing through" ADA), due to dose-related toxicity.

The murine SP34 (mSP34) antibody binds human CD3 and cross reacts with many primate CD3 proteins with similar affinity (Pessano, et al., *EMBO J.* (1985) 4:337-344, Conrad, et al. *Cytometry A*. (2007) 71:925-933). For this reason, humanized variants of mSP34 (huSP34) are among the most commonly used anti-CD3 domains in clinical stage bispecific antibodies. To better understand potential sources of immunogenicity, we conducted a primary sequence analysis of mSP34 as well as a panel of six clinical stage huSP34 variants. Sequences were obtained from the WHO Drug Information INN lists (who.int/medicines/publications/druginformation/innlists/en/), and all antibodies with ≤2 amino acid mismatches to mSP34 across both CDR H3 and CDR L3 were compiled. The variable heavy (VH) and variable light (VL) sequences of these antibodies along with that of Trastuzumab (anti-HER2) were compared to the closest human germlines using the IMGT domain-gap-align server (imgt.org/3Dstructure-DB/cgi/DomainGapAlign.cgi). The results of this analysis (Table 1) demonstrate that mSP34 and all clinical stage comparators that were analyzed exhibit lower variable (Fv) identity to the human germline (≤80% ID) when compared to Trastuzumab (82% ID), a humanized antibody with low clinical ADA rates (Jackisch, et al., *Annals of Oncology* (2015) 26: 320-325).

TABLE 1

Similarity of mSP34 Fv and clinical stage huSP34 Fv to the human germline

| Name | VH % ID Human Germline | Closest Human VH Germline | VL % ID Human Germline | Closest Human VL Germline | Fv % ID Human Germline |
|---|---|---|---|---|---|
| mSP34 Fv | 71 | IGHV3-73*01 IGHJ4*1 | 65 | IGLV7-46*01 IGLJ3*02 | 69 |
| Comparator #5 Fv | 80 | IGHV3-73*01 IGHJ4*01 | 77 | IGLV7-46*01 IGLJ3*02 | 79 |
| Comparator #1 Fv | 80 | IGHV3-73*01 IGHJ4*01 | 78 | IGLV7-46*01 IGLJ3*02 | 79 |
| Comparator #2 Fv | 75 | IGHV3-73*01 IGHJ4*01 | 73 | IGLV8-61*01 IGLJ3*02 | 74 |
| Comparator #3 Fv | 81 | IGHV3-72*01 IGHJ4*01 | 79 | IGLV7-46*01 IGLJ3*02 | 80 |
| Comparator #4 Fv | 80 | IGHV3-23*03 IGHJ4*01 | 80 | IGLV7-46*01 IGLJ3*02 | 80 |
| hu4D5 Fv Trastuzumab | 78 | IGHV3-66*01 IGHJ4*01 | 87 | IGKV1-39*01 IGKJ1*01 | 82 |

In addition to the primary sequence, post-translational modification to antibodies, such as oxidation, deamidation and aspartate isomerization have also been implicated in the immunogenicity of biotherapeutics (FDA Guidance For Industry "Immunogenicity Assessment for Therapeutic Protein Products," by U.S. Department of Health and Human Services Food and Drug Administration, Center for Drug Evaluation and Research (CDER), Center for Biologics Evaluation and Research (CBER), August 2014, Clinical/Medical; available at fda.gov/media/85017/download). The primary sequence of a biotherapeutic contributes to the risk of these modifications, and as such, they are often referred to as "sequence liabilities." Modification of sequence liabilities can also lead to structural and functional heterogeneity in the final purified product that can complicate manufacturing and product stability (Lu, et al., *mAbs* (2019) 11:45-57). To better understand if mSP34 and clinical stage huSP34 variants contained solvent exposed sequence liabilities, we generated mSP34 homology models and conducted a primary sequence analysis of all solvent exposed sequence liabilities in mSP34 and clinical stage comparator Fv domains (FIGS. 1-2). The results suggest that mSP34 and many huSP34 variants contains several theoretical sequence liabilities that could potentially lead to product heterogeneity, manufacturing difficulties and increased immunogenic risk.

Aggregation propensity has also been associated with the immunogenicity of biotherapeutics (Rosenberg, *AAPS J.*

(2006) 8:E501-507, Seidl, et al. *Pharm Res.* (2012) 29:1454-1467). Engineering of antibodies including humanization and conversion to scFv formats can lead to unintended increases in aggregation propensity (Glockshuber, et al., *Biochemistry* (1990) 29: 1362-1367, Wörn and Plückthun. *J. Mol. Biol.* (2001) 305: 989-1010). It is not known if humanization of mSP34 or other anti-CD3 binding domains can influence the aggregation propensity and/or immunogenic risk of CD3 engaging bispecific antibodies.

The affinity of anti-CD3 antibodies has been reported to impact both targeted cell-killing potency as well as pharmacokinetics (PK) (Ellerman, *Methods* (2019) 154:102-117). In animal models containing cross-reactive CD3 antigens, anti-CD3 antibodies with higher affinities (<10 nM) are associated with reduced antibody half-life, while anti-CD3 antibodies with lower affinities (>10 nM) are associated with improved antibody half-life similar to that observed in the same animal model without a cross-reactive CD3 antigen (Leong, et al., *Blood* (2017) 129:609-618). This suggests that CD3 target mediated drug disposition (TMDD) may play a role in limiting the PK half-life of high affinity anti-CD3 mAbs. However, antibody polyspecificity or polyreactivity can also influence the PK half-life of antibodies (Hötzel, et al., *mAbs* (2012) 4:753-760) and mutations that increase antibody affinity are sometimes associated with reductions in antibody specificity (Rabia et al., *Biochem Eng. J.* (2018) 137:365-374). It is not clear if it is possible to identify an anti-CD3 antibody with both high CD3 affinity and corresponding high targeted killing potency with the PK characteristics of a typical IgG.

Based on these challenges and considerations, we sought to develop an anti-CD3 antibody variable domain with (i) a high affinity for human and non-human primate (NHP) (e.g., to facilitate pre-clinical toxicity studies) CD3, (ii) a high sequence similarity to the human germline (e.g., to reduce or eliminate risk of immunogenicity and ADA reactions in human patients), (iii) IgG-like PK properties with no evidence of ADA in non-human primates (e.g., to facilitate pre-clinical efficacy and toxicity studies), (iv) reduced product heterogeneity via removal of sequence liabilities (e.g., deamidation, aspartate isomerization) to improve ease of manufacturing, (v) high thermodynamic stability (to ensure product stability), (vi) low aggregate content (to reduce risk of immunogenicity) and (vii) low polyspecificity (to reduce the risk of immunogenicity and improve PK properties). We also sought to develop such an anti-CD3 antibody with (viii) a heavy chain variable region (VH) with low or no binding to Protein A affinity chromatography resin in order to facilitate purification of bispecific antibody heterodimers. Finally, we sought to develop an anti-CD3 antibody variable domain that possessed all these properties as an scFv or Fab, such that it could be incorporated into a variety of bispecific antibody formats containing three or fewer polypeptide chains to limit light chain miss-pairing or other sources of bispecific antibody product heterogeneity (Example 2).

We selected the murine SP34 antibody as a starting point for humanization because it binds human CD3 and cross-reacts with many primate CD3 proteins (Pessano, et al. *EMBO J.* (1985) 4:337-344, Conrad, et al., *Cytometry A* (2007) 71:925-933).

The sequences of the murine SP34 (mSP34) variable heavy (VH) and variable light (VL) domains are shown below.

mSP34 VH (SEQ ID NO: 713)
EVKLLESGGGLVQPKGSLKLSCAASGFTFNTYAMNWVRQAPGKGLEWVAR

IRSKYNNYATYYADSVKDRFTISRDDSQSILYLQMNNLKTEDTAMYYCVR

HGNFGNSYVSWFAYWGQGTLVTVSA mSP34 VL (SEQ ID NO: 714)
QAVVTQESALTTSPGETVTLTCRSSTGAVTTSNYANWVQEKPDHLFTGLI

GGTNKRAPGVPARFSGSLIGDKAALTITGAQTEDEAIYFCALWYSNLWVF

GGGTKLTVLG

Figure 3:
FIG. 3 illustrates a structural superposition of homology models of mSP34 (white) and the closest human germline (black) found using the IMGT domain gap align server. The models were created using Discovery Studio 2017r2 (Biovia) and superposed using PyMOL (Schrödinger, Inc.). The Cα backbone trace is shown.
Figure 6A:
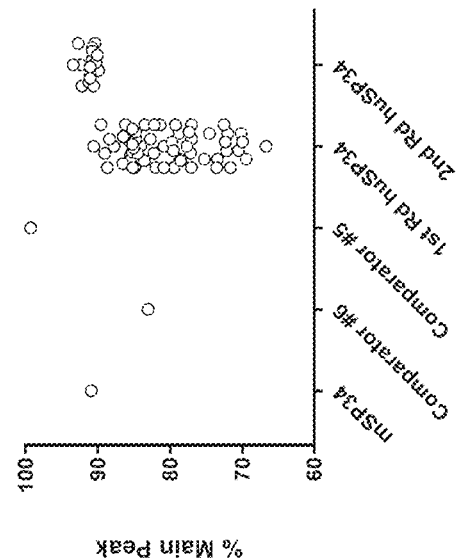
FIGS. 6A-6D illustrate an analysis of anti-CD3 affinity (Octet BLI) (FIG. 6A), charge homogeneity (CX-1) (FIG. 6B), aggregation propensity (size exclusion column (SEC)) (FIG. 6C) and match to the human germline (FIG. 6D) for the first and second round huSP34 Fab variants, mSP34 human chimeric Fab and comparator huSP34 Fab molecules.
Figure 6C:
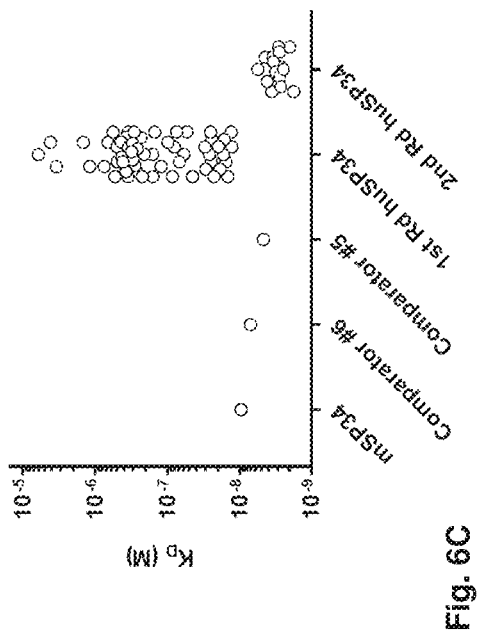
Figure 6B:
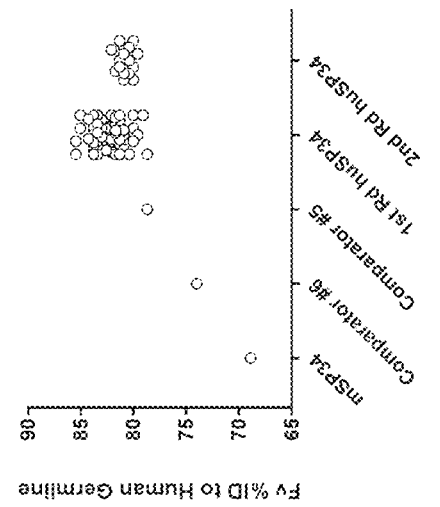
Figure 6D:
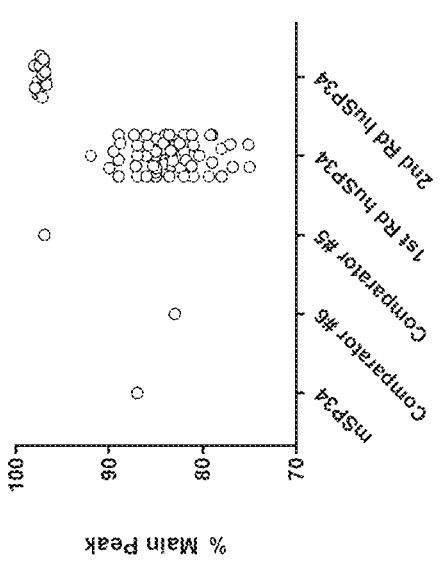
Figure 7A:
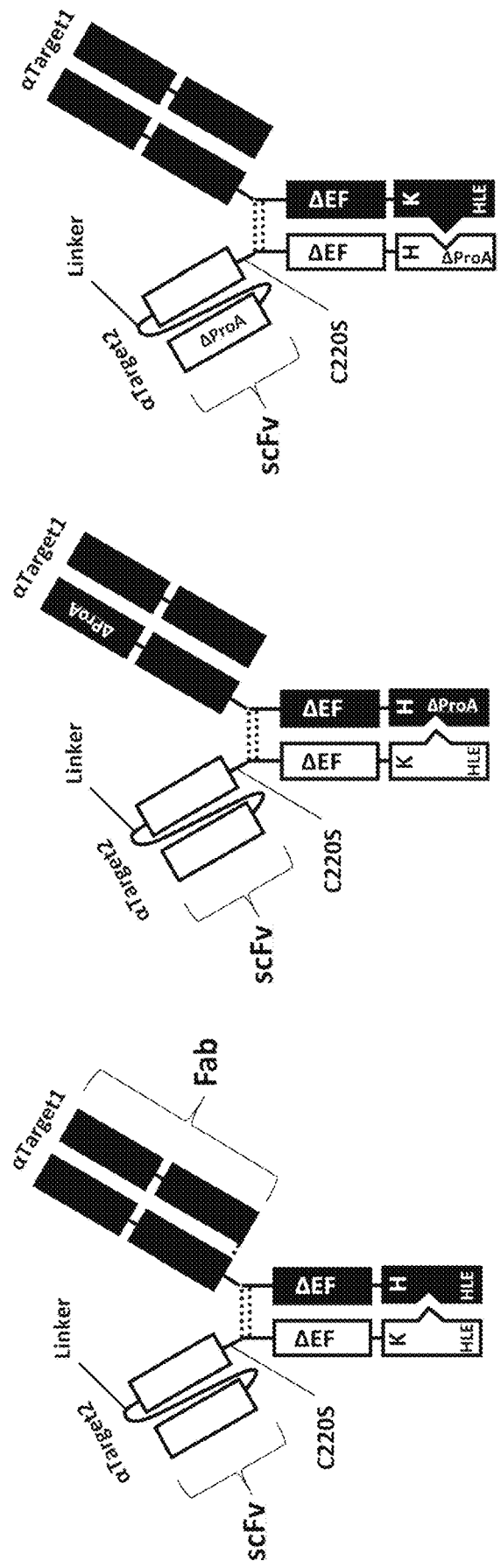

The mSP34 VH and VL sequences were compared to the IMGT database (imgt.org) to identify suitable target human germlines for humanization. The closest heavy chain variable (V) and joining (J) segment matches identified were IGHV3-72 and IGHJ6 respectively. The closest light chain variable (V) and joining (J) segment matches identified were IGLV7-46 and IGLJ3 respectively. Next, we used the default homology modeling protocol in Discovery Studio 2017r2 (Biovia) to generate a structure model of mSP34, using a dual-affinity re-targeting (DART®) bispecific molecule as a template for homology modeling (Root, et al., *Antibodies* (Basel) (2016) 5(1):6; RCSB Protein Data Bank (PDB) ID: 5FCS; rcsb.org/structure/5FCS). We further used the default antibody modeling cascade protocol in Discovery Studio 2017r2 to generate structural models of the target human germline antibodies. By superposing these two homology models (FIG. 3), we identified CDR graft points as well as framework residues from mSP34 to retain in huSP34. Consistent with the goals outlined above, we also explored whether mSP34 CDR residues could be mutated to human germline residues in order to increase identity to the human germline and further reduce the risk of immunogenicity, whether germline consensus residues and structure guided salt-bridges could be used to stabilize and/or improve structural or functional properties, and also mutated residues involved in putative sequence liabilities to assess their role in product heterogeneity.

The initial round of structure-based humanization for mSP34 led to the design of 6 VL and 10 VH variants. The sequences of these variants are shown aligned to mSP34 and the human germline target VH and VL sequences in FIGS. 4A-4B. The human germline identity of all 60 possible huSP34 combinations are shown in Table 2. The amino acid sequences of the variable region sequences of HC1-HC10 are provided in Table 3. The amino acid sequences of the variable region sequences of LC1-LC6 are provided in Table 4.

TABLE 2

First round huSP34 Fv variant percentage identify to the human germline

|  | HC1 | HC2 | HC3 | HC4 | HC5 | HC6 | HC7 | HC8 | HC9 | HC10 |
|---|---|---|---|---|---|---|---|---|---|---|
| LC1 | 80 | 80 | 79.6 | 80 | 79.1 | 78.7 | 81.3 | 81.3 | 81.7 | 81.7 |
| LC2 | 82.1 | 82.1 | 81.7 | 82.1 | 81.3 | 80.9 | 83.4 | 83.4 | 83.8 | 83.8 |
| LC3 | 82.1 | 82.1 | 81.7 | 82.1 | 81.3 | 80.9 | 83.4 | 83.4 | 83.8 | 83.8 |
| LC4 | 82.6 | 82.6 | 82.1 | 82.6 | 81.7 | 81.3 | 83.8 | 83.8 | 84.3 | 84.3 |
| LC5 | 83.8 | 83.8 | 83.4 | 83.8 | 83 | 82.6 | 85.1 | 85.1 | 85.5 | 85.5 |
| LC6 | 81.7 | 81.7 | 81.3 | 81.7 | 80.9 | 80.4 | 83 | 83 | 83.4 | 83.4 |

TABLE 3

Amino Acid Sequences of the Variable Region Sequences of HC1-HC10

| Name | SEQ ID NO: | Amino acid sequence |
|---|---|---|
| HC1 | 53 | EVQLVESGGGLVQPGGSLRLSCAASGFTFNTYAMNWVRQAPGKGLE WVGRIRSKYNNYATYYAASVKGRFTISRDDSKNSLYLQMNSLKTED TAMYYCVRHGNFGNSYVSWFAYWGQGTLVTVSS |
| HC2 | 715 | EVQLVESGGGLVQPGGSLRLSCAASGFTFSTYAMNWVRQAPGKGLE WVGRIRSKYNNYATYYAASVKGRFTISRDDSKNSLYLQMNSLKTED TAMYYCVRHGNFGNSYVSWFAVWGQGTLVTVSS |
| HC3 | 50 | EVQLVESGGGLVQPGGSLRLSCAASGFTFNTYAMNWVRQAPGKGLE WVGRIRSKYNNYATYYADSVKGRFTISRDDSKNSLYLQMNSLRTED TAVYYCVRHGNFGHSYVSWFAYWGQGTLVTVSS |
| HC4 | 716 | EVQLVESGGGLVQPGGSLRLSCAASGFTFSTYAMNWVRQAPGKGLE WVGRIRSKYNNYATYYAASVKGRFTISRDDSKNSLYLQMNSLRTED TAVYYCVRHGNFGHSYVSWFAVWGQGTLVTVSS |
| HC5 | 717 | EVQLVESGGGLVQPGGSLRLSCAASGFTFSTYAMNWVRQAPGKGLE WVGRIRSKYNNYATYYADSVKGRFTISRDNSKNTLYLQMNSLRAED TAVYYCVRHGNFGHSYVSWFAVWGQGTLVTVSS |
| HC6 | 718 | EVQLVESGGGLVQPGGSLRLSCAASGFTFSTYAMNWVRQAPGKGLE WVGRIRSKYNNYATYYADSVKGRFTISRDNSKNTLYLQMNSLRAED TAMYYCVRHGNFGNSYVSWFAVWGQGTLVTVSS |
| HC7 | 719 | EVQLVESGGGLVQPGGSLRLSCAASGFTFSDYAMNWVRQAPGKGLE WVGRTRSKYNNYATYYAASVKGRFTISRDDSKNSLYLQMNSLKTED TAVYYCVRHGNFGNSYVSWFAVWGQGTLVTVSS |
| HC8 | 720 | EVQLVESGGGLVQPGGSLRLSCAASGFTFSDYAMNWVRQAPGKGLE WVGRTRSKYNNYATYYAASVKGRFTISRDDSKNSLYLQMNSLKTED TAVYYCVRHGNFGHSYVSWFAVWGQGTLVTVSS |
| HC9 | 721 | EVQLVESGGGLVQPGGSLRLSCAASGFTFSDYAMNWVRQAPGKGLE WVGRTRSKYNSYATYYAASVKGRFTISRDDSKNSLYLQMNSLKTED TAVYYCVRHGNFGNSYVSWFAVWGQGTLVTVSS |
| HC10 | 722 | EVQLVESGGGLVQPGGSLRLSCAASGFTFSDYAMNWVRQAPGKGLE WVGRTRSKYNSYATYYAASVKGRFTISRDDSKNSLYLQMNSLKTED TAVYYCVRHGNFGHSYVSWFAVWGQGTLVTVSS |

TABLE 4

Amino Acid Sequences of the Variable Region Sequences of LC1-LC6

| Name | SEQ ID NO: | Amino acid sequence |
|---|---|---|
| LC1 | 723 | QAVVTQEPSLTVSPGGTVTLTCRSSTGAVTTSNYANWVQQKPGQAP RGLIGGTNKRAPWTPARFSGSLIGDKAALTLSGAQPEDEAEYYCAL WYSNLWVFGGGTKLTVL |

TABLE 4-continued

Amino Acid Sequences of the Variable Region
Sequences of LC1-LC6

| Name | SEQ ID NO: | Amino acid sequence |
|---|---|---|
| LC2 | 724 | QAVVTQEPSLTVSPGGTVTLTCGSSTGAVTTSNYANWVQQKPGQAP<br>RGLIGGTSNRAPWTPARFSGSLLGGKAALTLSGAQPEDEAEYYCAL<br>WYSNLWVFGGGTKLTVL |
| LC3 | 57 | QAVVTQEPSLTVSPGGTVTLTCGSSTGAVTTGHYANWVQQKPGQAP<br>RGLIGGTNKRAPWTPARFSGSLLGGKAALTLSGAQPEDEAEYYCAL<br>WYSNLWVFGGGTKLTVL |
| LC4 | 725 | QAVVTQEPSLTVSPGGTVTLTCGSSTGAVTTSHYANWVQQKPGQAP<br>RGLIGGTSKRAPWTPARFSGSLLGGKAALTLSGAQPEDEAEYYCAL<br>WYSALWVFGGGTKLTVL |
| LC5 | 726 | QAVVTQEPSLTVSPGGTVTLTCGSSTGAVTTGHYANWVQQKPGQAP<br>RGLIGGTSNRAPWTPARFSGSLLGGKAALTLSGAQPEDEAEYYCAL<br>WYSARWVFGGGTKLTVL |
| LC6 | 727 | QAVVTQPPSLTVSPGGTVTLTCGSSTGAVTTGHYANWVQQKPGQAP<br>RGLIGGTSNRAPGVPARFSGSLSGGKAALTISGAQPEDEAEYYCAL<br>WYSARWVFGGGTKLTVL |

All 60 possible combinations of huSP34 heavy chain and light chain variants (the 1st round huSP34 variants), as well as the mSP34 parent antibody and a comparator huSP34 molecule (Comparator #6), were then expressed in HEK293 cells as Fabs incorporating a human CH1 domain and a human lambda light chain constant domain. The heavy chain Fab polypeptide incorporated a C-terminal His8-Flag tag (His8 or HHHHHHHH disclosed as SEQ ID NO: 1041) to facilitate purification using standard nickel affinity chromatography methods (Porath, et al., Nature (1975) 258: 598-599). The resulting Fabs were subjected to analysis using the following methods: expression titer assessment, analytical size exclusion chromatography (SEC) to assess structural heterogeneity, analytical CX-1 ion exchange chromatography to assess charge heterogeneity, thermal denaturation to determine melting temperature (Tm) and aggregation temperature (Tagg), competition flow cytometry binding to primary T-cells to assess relative T-cell binding compared to mSP34, affinity analysis using Octet in order to assess relative binding kinetics ($k_{on}$ and $k_{off}$) and dissociation constants ($K_D$), and competition flow cytometry assays to assess relative binding affinity to human T-cells as outlined in Examples 4, 5, 7 and 8.

The resulting data revealed several unexpected observations. The majority of humanized Fab variants from round 1 had significantly higher melting temperatures than the chimeric mSP34 Fab containing mSP34 variable regions fused to human constant domains. This suggested that the structure-guided humanization improved the thermodynamic stability of this molecule (Example 4). However, both the competition flow cytometry and Octet biolayer interferometry (BLI) assays suggested that the round 1 huSP34 variants had reduced CD3 binding affinity compared to the mSP34 chimeric Fab (Examples 5 and 8). Furthermore, the majority of purified round 1 huSP34 Fab variants demonstrated more charge-based heterogeneity when analyzed using strong cation exchange chromatography, and an increase in aggregate levels as measured by size exclusion chromatography when compared to mSP34 chimeric Fab (Example 4). By analyzing the relationship between the sequences of the huSP34 variants and their functional and biophysical properties (sequence-activity relationships or SAR) we identified multiple amino acids associated with improved properties (Examples 4 and 5). This allowed for the rational design of new variants (the second round huSP34 variants) incorporating mutations designed to optimize the various functional and biophysical properties assayed (Examples 4, 5, 7 and 8). The sequences of the heavy chain and light chain variable domains used in the second round huSP34 variants are shown in FIGS. 5A-5B.

All 16 possible combinations of the second round huSP34 heavy chain and light chain variants were expressed in HEK293 cells as Fabs incorporating a human CH1 domain and a human lambda light chain constant domain. The human germline identities of the second round huSP34 variants are shown in Table 5. The amino acid sequences of the variable region sequences of HC11-HC13 are provided in Table 6. The amino acid sequences of the variable region sequences of LC7-LC10 are provided in Table 7. The heavy chain Fab polypeptide incorporated a C-terminal His8-Flag tag (His8 or HHHHHHHH disclosed as SEQ ID NO: 1041) to facilitate purification using standard nickel affinity chromatography methods (Porath, et al., supra). After purification, the resulting Fabs were subjected to analysis using the following methods: analytical size exclusion chromatography (SEC), analytical CX-1 ion exchange chromatography, affinity analysis using Octet, and competition flow cytometry on human T-cells as outlined in Examples 4, 5, and 8. The results of the analysis revealed that our SAR guided approach was successful, as many of the second round huSP34 variants had improved affinity, improved CX-1 profiles (e.g. reduced heterogeneity) and improved SEC profiles (e.g. reduced aggregate levels) all while maintaining a high match to the human germline when compared to the first-round variants, the mSP34 chimeric Fab and comparator molecules (FIG. 6).

TABLE 5

Second round huSP34 Fv variant percentage
identify to the human germline

|  | HC3 | HC11 | HC12 | HC13 |
|---|---|---|---|---|
| LC7 | 80 | 80.9 | 80.4 | 81.3 |
| LC8 | 80.9 | 81.7 | 81.3 | 82.1 |

TABLE 5-continued

Second round huSP34 Fv variant percentage identify to the human germline

| | HC3 | HC11 | HC12 | HC13 |
|---|---|---|---|---|
| LC9 | 79.6 | 80.4 | 80 | 80.9 |
| LC10 | 80 | 80.9 | 80.4 | 81.3 |

TABLE 6

Amino Acid Sequences of the Variable Region Sequences of HC11-HC13

| Name | SEQ ID NO: | Amino acid sequence |
|---|---|---|
| HC11 | 728 | EVQLVESGGGLVQPGGSLRLSCAASGFTFSTYAMNWVRQAPGKGLE WVGRIRSKYNNYATYYAASVKGRFTISRDDSKNSLYLQMNSLRTED TAVYYCVRHGNFGHSYVSWFAYWGQGTLVTVSS |
| HC12 | 729 | EVQLVESGGGLVQPGGSLRLSCAASGFTFSTYAMNWVRQAPGKGLE WVARIRSKYNNYATYYAASVKGRFTISRDDSKNSLYLQMNSLRTED TAVYYCVRHGNFGHSYVSWFAYWGQGTLVTVSS |
| HC13 | 730 | EVQLVESGGGLVQPGGSLRLSCAASGFTFSTYAMNWVRQAPGKGLE WVGRIRSKYNNYATYYAASVKGRFTISRDDSKNTLYLQMNSLRTED TAVYYCVRHGNFGHSYVSWFAYWGQGTLVTVSS |

TABLE 7

Amino Acid Sequences of the Variable Region Sequences of LC7-LC10

| Name | SEQ ID NO: | Amino acid sequence |
|---|---|---|
| LC7 | 731 | QAVVTQEPSLTVSPGGTVTLTCRSSTGAVTTGHYANWVQQKPGQAP RGLIGGTNKRAPGVPARFSGSLLGGKAALTISGAQPEDEAEYYCAL WYSNLWVFGGGTKLTVL |
| LC8 | 58 | QAVVTQEPSLTVSPGGTVTLTCGSSTGAVTTGHYANWVQQKPGQAP RGLIGGTNKRAPGVPARFSGSLLGGKAALTISGAQPEDEAEYYCAL WYSNRWVFGGGTKLTVL |
| LC9 | 732 | QAVVTQPPSLTVSPGGTVTLTCGSSTGAVTTGHYANWVQQKPGQAP RGLIGGTNKRAPGVPARFSGSLSGGKAALTISGAQPEDEAEYYCAL WYSNLWVFGGGTKLTVL |
| LC10 | 733 | QAVVTQPPSLTVSPGGTVTLTCGSSTGAVTTGHYANWVQQKPGQAP RGLIGGTNKRAPGVPARFSGSLSGGKAALTISGAQPEDEAEYYCAL WYSNRWVFGGGTKLTVL |

Selected first and second round huSP34 Fab variants were next reformatted as anti-HIV gp120 bispecific antibodies (Example 2). These antibodies were assessed in vitro in T-cell binding (Example 9) and T-cell mediated killing assays targeting HIV infected cells (Examples 10-11). The results demonstrated that the bispecific antibodies incorporating the huSP34 anti-CD3 binding arms potently killed HIV infected cells, and also showed the killing potency was directly correlated with anti-CD3 affinity.

Selected bispecific antibodies containing first and second round huSP34 variants were next tested in non-human primate PK assays (Example 13). Antibodies were tested in the presence and absence of Fc mutations, each made in only one of the two Fc domains, known to impact Protein A binding as well as enhance FcRn binding. Surprisingly, bispecific antibodies incorporating the lower affinity first round huSP34.1.3 scFv showed ideal IgG-like PK properties and no evidence of ADAs, consistent with our design goals, while bispecific antibodies incorporating the higher affinity second round huSP34.13.10 scFv demonstrated increased clearance, reduced half-life and high apparent rates of ADA induction. While mutations that eliminated Protein A binding (e.g. H435R, H435R+Y436F, Jendeberg, et al., *J. Immunol. Methods* (1997) 201:25-34) did not appear to significantly impact PK, certain mutations that improved pH dependent FcRn binding (YTE) did appear to mitigate some of the undesirable PK properties introduced by the high affinity huSP34.13.8 variant. Unfortunately, these FcRn binding mutations did not appear to eliminate the apparent high ADA rates observed for bispecific antibodies incorporating higher affinity second round huSP34 scFv domains. The huSP34.1.3 variant did not show the highest potency in our killing assays, and it also contained the N100 residue in CDR H3 that appeared to be associated with increased product heterogeneity. We thus set out to conduct a third round of humanization seeking to identify a high affinity huSP34 variant containing the N100H mutation in CDRH3 and demonstrating ideal IgG-like PK properties and no evidence of ADA induction in non-human primates.

Although CD3 affinity has been directly implicated in the PK properties of bispecific antibodies (Ellerman, *Methods* (2019) 154:102-117), antibody polyspecificity can also influence PK (Hotzel, et al., *mAbs* (2012) 4:753-760) and was not tested during the first and second rounds of humanization. We thus generated a panel of the highest affinity huSP34 variants from rounds one and two as human IgG1 antibodies, thus enabling additional biophysical assessment (Example 4) including polyspecificity analysis using baculoviral particle (BVP) assays (Example 7). The BVP results revealed significant differences in polyspecificity within the huSP34 IgG1 panel. Selected bispecific antibodies, including those containing the huSP34.1.3 and huSP34.13.10 scFv were also tested in the BVP assay and revealed a direct correlation between moderate to high BVP scores and poor PK parameters.

We next used the BVP data to guide the selection of three distinct huSP34 variants to be used as starting points for the third round of humanization. The huSP34.1.3 variant was selected based on its low BVP score and ideal PK properties. The huSP34.3.8 variant was selected based on its low BVP score, high affinity and excellent results across all biophysical screening assays. The huSP34.1.10 variant had not yet been produced or tested in any form, but was selected based on the observation of SAR around HC1 and LC10—both of which were associated with the lowest BVP scores. To determine if polyspecificity or affinity attributes contributed to the in vivo PK properties of the huSP34 containing bispecific antibodies, we generated variants with a range of affinities using SAR data from the first and second rounds of humanization. We further incorporated the N100H mutation into all tested variants (where not already present in any of the three lead variants) to eliminate the HC CDR H3 deamidation motif and reduce product heterogeneity as observed in the analytical CX-1 analysis. The identity of the third round huSP34 variants compared to the human germline is shown in Table 8. The amino acid sequences of the variable region sequences of HC34-HC38 are provided in Table 9. The amino acid sequences of the variable region sequences of LC11-LC20 are provided in Table 10.

TABLE 8

Third round huSP34 Fv variant percentage identify to the human germline

| Heavy Chain Variant | Light Chain Variant | % ID human Germline |
|---|---|---|
| 34 | 10 | 80.4 |
| 34 | 14 | 81.3 |
| 34 | 15 | 80.9 |
| 34 | 12 | 81.3 |
| 34 | 6 | 81.7 |
| 35 | 10 | 81.3 |
| 34 | 16 | 82.1 |
| 35 | 14 | 82.1 |
| 34 | 17 | 81.7 |
| 35 | 15 | 81.7 |
| 34 | 18 | 82.6 |
| 35 | 12 | 82.1 |
| 35 | 6 | 82.6 |
| 36 | 10 | 80.9 |
| 37 | 10 | 80.9 |
| 3 | 13 | 81.7 |
| 3 | 19 | 81.3 |
| 38 | 13 | 82.6 |
| 34 | 3 | 82.1 |
| 34 | 11 | 81.3 |

TABLE 9

Amino Acid Sequences of the Variable Region Sequences of HC34-HC38

| Name | SEQ ID NO: | Amino acid sequence |
|---|---|---|
| HC34 | 52 | EVQLVESGGGLVQPGGSLRLSCAASGFTFNTYAMNWVRQAPGKGLE WVGRIRSKYNNYATYYAASVKGRFTISRDDSKNSLYLQMNSLKTED TAMYYCVRHGNFGHSYVSWFAYWGQGTLVTVSS |
| HC35 | 734 | EVQLVESGGGLVQPGGSLRLSCAASGFTFNDYAMNWVRQAPGKGLE WVGRTRSKYNNYATYYAASVKGRFTISRDDSKNSLYLQMNSLKTED TAMYYCVRHGNFGHSYVSWFAYWGQGTLVTVSS |
| HC36 | 735 | EVQLVESGGGLVQPGGSLRLSCAASGFTFNDYAMNWVRQAPGKGLE WVGRIRSKYNNYATYYAASVKGRFTISRDDSKNSLYLQMNSLKTED TAMYYCVRHGNFGHSYVSWFAYWGQGTLVTVSS |
| HC37 | 736 | EVQLVESGGGLVQPGGSLRLSCAASGFTFNTYAMNWVRQAPGKGLE WVGRTRSKYNNYATYYAASVKGRFTISRDDSKNSLYLQMNSLKTED TAMYYCVRHGNFGHSYVSWFAYWGQGTLVTVSS |
| HC38 | 737 | EVQLVESGGGLVQPGGSLRLSCAASGFTFNDYAMNWVRQAPGKGLE WVGRTRSKYNNYATYYADSVKGRFTISRDDSKNSLYLQMNSLRTED TAVYYCVRHGNFGHSYVSWFAYWGQGTLVTVSS |

TABLE 10

Amino Acid Sequences of the Variable Region Sequences of LC11-LC20

| Name | SEQ ID NO: | Amino acid sequence |
|---|---|---|
| LC11 | 738 | QAVVTQEPSLTVSPGGTVTLTCGSSTGAVTTGHYANWVQQKPGQAP RGLIGGTNKRAPGVPARFSGSLLGGKAALTLSGAQPEDEAEYYCAL WYSNLWVFGGGTKLTVL |

TABLE 10-continued

Amino Acid Sequences of the Variable Region Sequences of LC11-LC20

| Name | SEQ ID NO: | Amino acid sequence |
|---|---|---|
| LC12 | 739 | QAVVTQPPSLTVSPGGTVTLTCGSSTGAVTTGHYANWVQQKPGQAPRGLIGGTNKRAPWTPARFSGSLSGGKAALTISGAQPEDEAEYYCALWYSNRWVFGGGTKLTVL |
| LC13 | 56 | QAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVL |
| LC14 | 740 | QAVVTQPPSLTVSPGGTVTLTCGSSTGAVTTGHYANWVQQKPGQAPRGLIGGTSNRAPGVPARFSGSLSGGKAALTISGAQPEDEAEYYCALWYSNRWVFGGGTKLTVL |
| LC15 | 741 | QAVVTQPPSLTVSPGGTVTLTCGSSTGAVTTGHYANWVQQKPGQAPRGLIGGTNKRAPGVPARFSGSLSGGKAALTISGAQPEDEAEYYCALWYSARWVFGGGTKLTVL |
| LC16 | 742 | QAVVTQPPSLTVSPGGTVTLTCGSSTGAVTTGHYANWVQQKPGQAPRGLIGGTSNRAPWTPARFSGSLSGGKAALTISGAQPEDEAEYYCALWYSNRWVFGGGTKLTVL |
| LC17 | 743 | QAVVTQPPSLTVSPGGTVTLTCGSSTGAVTTGHYANWVQQKPGQAPRGLIGGTNKRAPWTPARFSGSLSGGKAALTISGAQPEDEAEYYCALWYSARWVFGGGTKLTVL |
| LC18 | 744 | QAVVTQPPSLTVSPGGTVTLTCGSSTGAVTTGHYANWVQQKPGQAPRGLIGGTSNRAPWTPARFSGSLSGGKAALTISGAQPEDEAEYYCALWYSARWVFGGGTKLTVL |
| LC19 | 745 | QAVVTQEPSLTVSPGGTVTLTCGSSTGAVTTGHYANWVQQKPGQAPRGLIGGTNKRAPGVPARFSGSLLGGKAALTISGAQPEDEAEYYCALWYSARWVFGGGTKLTVL |

The third round huSP34 variants were next generated as Fabs or incorporated into anti-HIV gp120 targeting bispecific antibodies. These molecules were then characterized in BLI (Example 5) and SPR (Example 6) affinity assays, BVP polyspecificity assays (Example 7), T-cell binding assays (Example 9) and non-human primate PK analysis (Example 13). The T-cell binding assays confirmed that binding to human and NHP T-cells was nearly identical among all variants tested (Example 9). Surprisingly, and in contrast to previous literature reports (Leong, et al., *Blood* (2017) 129:609-618), the results presented here demonstrate no relationship between CD3 affinity and antibody clearance. More specifically, huSP34.3.8 and its variant huSP34.3.13 had both the highest anti-CD3 affinities (Example 6) and longest serum half-life among all molecules tested (Example 13). The huSP34.3.13 variant had both the lowest polyspecificity risk and the lowest clearance, suggesting that the BVP score may be a better predictor of anti-CD3 bispecific mAb PK properties than anti-CD3 affinity.

Example 2

Design, Expression and Purification of Anti-HIV-gp120 Bispecific Antibodies and Fc Fusion Proteins Containing huSP34 Anti-CD3 Binding Domains Many different bispecific antibody formats have been described, with many of these being used to develop therapeutic molecules (reviewed in Spiess and Carter, *Mol. Immunol.*, (2015) 67: 95-106, Labrijn, et al., *Nat. Rev. Drug Disc.* (2019) 18, 585-608). While early generation fragment-based formats built around one or two polypeptide chains and lacking an IgG Fc can be readily manufactured, they suffer from poor PK. Short half-life can increase the $C_{max}$ driven toxicity of CD3 directed bispecific antibodies and necessitates complex dosing (e.g. continuous infusion with Blinatumomab). While many technologies have been developed to facilitate heterodimerization of the Fc domain, no robust technologies exist to facilitate unique pairing of the heavy chain and light chain, thus necessitating the use of common light chain antibodies (Shiraiwa, et al., *Methods* (2019) 154:10-20) or the generation of multiple stable cell lines followed by either complex redox chemistry, or co-culturing methods to produce bispecific antibodies without light chain miss-pairing (Gramer, et al., *mAbs* (2013) 5:962-973, Spiess, et al., *Nat. Biotechnol.* (2013) 31:753-758, Shatz, et al., *mAbs* (2016) 8:1487-1497). Finally, even if Fc heterodimerization and appropriate light chain pairing can be achieved, homodimeric contaminants can be challenging to remove during manufacturing, reducing final yields and/or presenting safety risks. We therefore sought to design and produce a bispecific antibody with IgG-like manufacturing properties, IgG-like PK properties and incorporating technologies to simplify purification. Examples of bispecific antibody designs that may address these challenges are illustrated in FIGS. 7A-7D. The technologies that may be incorporated into these designs are described below.

In bispecific antibodies incorporating two antigen targeting antibody variable domains, the use of a single chain fragment variable (scFv) domain can directly eliminate mispairing of light chains by removing one light chain polypeptide from the construct. scFv fragments represent a minimal antibody-derived antigen binding unit and are generated by direct fusion of a variable heavy and variable light domain via a flexible polypeptide linker (Huston et al., *Proc Natl Acad Sci USA* (1988) 85(16):5879-83). The sequence of this linker can contain 3 or preferably 4 repeats of a GGGGS motif (SEQ ID NO: 712) (Desplancq, et al., *Protein Engineering* (1994) 7:1027-1033). The G44C mutation (variable heavy domain) and the G100C mutation (variable light domain) may also be used to generate a covalent disulfide bond between the VH and VL domains of the scFv if additional thermodynamic stability is required (Brinkmann, et al., *Proc Natl Acad Sci USA* (1993) 90(16):7538-42).

To maximize heterodimerization of the two different heavy chain-containing species, so-called 'knobs-into-holes' mutations can be introduced into the Fc regions (Atwell, et al., *J Mol Biol* (1997) 270(1):26-35). The 'hole' mutations (T366S, L368A and Y407V) are incorporated into one Fc-containing chain, while the T366W 'knob' mutation is used in the other chain (Atwell, et al., supra). These mutations will also be referred to as "SAV" and "W" respectively herein. In addition, the C220S mutation is incorporated into the IgG1 hinge region of the scFv-containing arm to eliminate a free cysteine (in the context of a native IgG, this cysteine is responsible for forming a disulfide bond with a corresponding cysteine in the light chain). Co-transfection of such constructs leads to preferential formation of a heterodimeric Fc, with low levels of homodimer contaminants. The S354C (made in the Fc containing the 'knob' mutations) and Y349C (made in the Fc containing the 'hole' mutations) mutations may optionally be used to generate a covalent bond between the two halves of the heterodimeric Fc if additional thermodynamic stability is required (Merchant, et al., *Nat. Biotechnol.* (1998) 16: 677-81).

To facilitate purification of the heterodimeric molecule away from contaminating homodimeric products, the H435R or H435R+Y436F mutations found in IgG3 allotypes may be introduced in either of the Fc-containing chains (Jendeberg, et al., supra). These mutations, which will be referred to as "R" or "RF" respectively, eliminate Protein A and FcRn binding when introduced in to the IgG1 Fc. When incorporated into only a single Fc domain in the context of a bispecific antibody construct, these mutations can eliminate Protein A binding of any homodimer contaminant containing these mutations, and greatly simplifies purification of the desired heterodimer away from the single remaining homodimer contaminant via additional chromatography steps (e.g. ion exchange). If one of the antibody variable domains is a VH3 family member (known to bind Protein A in addition to the Fc), additional engineering can be conducted to remove residual VH3 Protein A binding (Example 3).

Technologies to enhance PK half-life of IgG antibodies can be introduced into bispecific antibodies including Fc mutations such as M428L+N434S (LS) or M252Y+S254T+T256E (YTE) that improve pH dependent binding to FcRn and have been shown to significantly improve antibody half-life (Zalevsky, et al., *Nat. Biotechnol.* (2010) 28:157-159; Dall'Acqua, et al., *J. Biol. Chem.* (2006) 281:23514-23524). In the context of a bispecific antibody, and in particular a bispecific antibody containing mutations to knock out Fc Protein A binding (which also reduce FcRn binding), the LS or YTE mutations may only be introduced into the Fc polypeptide lacking the Protein A binding knockout mutations.

Many applications of bispecific antibodies require that the Fc domain is devoid of effector function (ADCC, ADCP, CDC). In these contexts, the L234A and L235A mutations to reduce or eliminate FcγR binding (Chappel, et al., *Proc Natl Acad Sci USA* (1991) 88(20):9036-40), and the P331S mutations to reduce or eliminate C1q binding (Xu, et al., *J Biol Chem.* (1994) 269:3469-74) may be used. This set of mutations will be referred to as "AAS" herein.

To express the anti-HIV gp120 bispecific antibodies described herein (FIG. 7A), the VH coding sequences of anti-HIV gp120 broadly neutralizing antibody variants were codon-biased for improved *Homo sapiens* expression and cloned into pcDNA3.1 vector containing immunoglobulin Fc (CH1-CH3) with AAS, SAV, W, R or RF mutations in various combinations (HC1). Broadly neutralizing antibody variable domains used include PGT121.66 and PGT121.42 (described in WO2018237148) and 3BNC117 1.52.64-1 (described in WO2020010107). Codon-biased VL sequences were cloned into pcDNA3.1 vector containing human light chain constant region (LC). The VH and VL coding sequences of various huSP34 variants connected by four repeats of G4S linker (GGGGS)$_4$ (SEQ ID NO: 750) were cloned into pcDNA3.1 vector containing the immunoglobulin Fc (CH2-CH3) containing AAS, SAV, W, R or RF mutations in various combinations (HC2). Transfection of Expi293 cells was conducted according to manufacturer's protocol. One microgram total DNA was used per ml transfection. The plasmids were combined in a ratio of 25% HC1:50% LC:25% HC2 (w/w) when co-transfecting into Expi293 cells. Four days post-transfection, the cell-free culture media was harvested. Expression titer was determined by using PhyTips® harboring 20 μl of MabSelect™ SuRe™ resin using 200 μl of clarified supernatant. Formation of heterodimer was monitored by size fractionation on SDS/polyacrylamide gel electrophoresis.

Extracellular domains 1 and 2 (D1D2) of the human CD4 protein bind HIV gp120, and when fused to Fc domains or incorporated into engineered T-cells, also have the ability to neutralize HIV and/or kill HIV infected cells (see, e.g., Capon, et al., *Nature* (1989) 337(6207):525-31; Zhen, et al., *PLoS Pathog* (2017) 13(12):e1006753: Leibman, et al., *PLoS Pathog.* (2017) 13(10):e1006613; Carillo, et al, *Transl Res.* (2017) 187:83-92; Kamata, et al., *Biochem Biophys Res Commun.* (2015) 463(3):216-21; Liu, et al., *J Virol.* (2015) 89(13):6685-94; Sahu, et al., *Virology.* (2013) 446(1-2):268-75; Scholler, et al., *Sci Transl Med.* (2012) 4(132):132ra53). Derivatives of CD4 have demonstrated broad antiviral activity. For example, PRO542 is a tetravalent CD4-IgG2 fusion that contains extracellular domains 1 and 2 of CD4. PRO542 exhibited potent, broad antiviral activity across different HIV clades (A-F) in vitro (Trkola, et al., *J Virol.* (1998) 72(3):1876-85; Trkola, et al., *J Virol.* (1995) 69(11):6609-17) and demonstrated antiviral activity in the clinic (Jacobson J M, 2000). However, protein therapeutics incorporating CD4 D1D2 have also demonstrated poor PK properties, hypothesized to be a result of either WWII binding or polyspecificity (Chen, et al., *J Virol.* (2014) 88(2):1125-39). Recent work has identified an engineered CD4 domain known as CD4 D1.22 that has been improved for higher gp120 binding affinity and reduced polyspecificity (Chen, et al., *J Virol* (2011) 85(18):9395-405; Chen, et al., *J Virol.* (2014) 88(2):1125-39; Myszka, et al., *Proc Natl Acad Sci USA* (2000) 97(16):9026-31). A greater than 10-fold increase in HIV gp120 binding affinity was reported for CD4 D1.22 compared to wild-type 2 domain CD4 (D1D2) (Chen, et al., *J Virol* (2011) supra). In addition, CD4 D1.22 exhibited reduced non-specific binding to an MEW class II expressing B-cells compared to wild-type CD4 (D1D2) (Chen, et al., *J Virol.* (2014) supra). To understand if CD4 D1D2 or CD4 D1.22 could serve as an HIV targeting domain, we next designed, expressed and purified a panel of bispecific fusion proteins incorporating huSP34 scFv or Fab variants fused to a first Fc domain and CD4 D1D2 or CD4 D1.22 extracellular domains (ECDs) fused to a second Fc domain. Versions with monovalent, bivalent and tandem CD4 ECD domains (FIGS. 7B-7D) were screened in CD3 binding assays (Example 6), infected T cell killing and binding assays (Examples 10 and 11) and their PK were assessed in NHPs (Example 13).

To express the anti-HIV-gp120 ECD-Fc bispecific fusion constructs described herein (FIGS. 7B-7D), the CD4 D1.22 or CD4 D1-D2 coding sequence was cloned into pcDNA3.1 expression vector carrying an immunoglobulin Fc (CH2-CH3) with AAS, SAV, W, R or RF mutations in various combinations (HC1). The VH coding sequences of humanized SP34 variants were codon-biased for *Homo sapiens* expression and cloned into pcDNA3.1 containing an immunoglobulin Fc (CH1-CH3) with AAS, SAV, W, R or RF mutations in various combinations (HC2). Codon-biased of humanized SP34 variant VL sequences were cloned into pcDNA3.1 vector containing human lambda light chain (LC). In some cases, the VH and VL coding sequence connected by four repeats of G4S linker (GGGGS)$_4$ (SEQ ID NO: 750) was cloned into pcDNA3.1 vector containing the immunoglobulin CH2-CH3 Fc with AAS, SAV, W, R or RF mutations (HC2'). Transfection of Expi293 cells was conducted according to manufacturer's protocol. One microgram total DNA was used per ml transfection. The plasmids were combined in a ratio of 25% HC1:50% LC:25% HC2 (w/w) or 50% HC1:50% HC2' (w/w) when co-transfecting into Expi293 cells. Four days post-transfection, the cell-free culture media was harvested. Expression titer was determined by using PhyTips® harboring 20 µl of MabSelect™ SuRe™ resin using 200 µl of clarified supernatant. Formation of heterodimer is monitored by size fractionation on SDS/polyacrylamide gel electrophoresis.

To purify the bispecific antibody and protein fusion constructs described herein, culture supernatant was subjected to MabSelect™ SuRe™ affinity purification followed by ion exchange chromatography to isolate pure heterodimers using an ÄKTA FPLC (Cytiva Life Sciences) enclosed within a 4.0° C. chromatography chamber. Cell culture media was loaded onto a MabSelect™ SuRe™ (Cytiva Life Sciences) column. The column was washed with a low salt buffer of 25 mM Tris HCl pH 7.5, 25 mM NaCl for 10 column volumes (CV), then with a high salt buffer of 25 mM Tris HCl pH 7.5, 500 mM NaCl for 5CV to remove non-specific binding, and finally with a low salt wash of 25 mM Tris HCl pH 7.5, 25 mM NaCl for 10 CV. To elute the antibody, an isocratic elution step of 100 mM Sodium Acetate pH 3.7 (used with Protein A knockout mutation in huSP34 VH and Fc) or 100 mM Glycine pH 2.8 (used when no Protein A knockout mutations are present in huSP34 VH and Fc) was used. The eluted pool was neutralized to pH 6.0 with 1M Tris HCl pH 9.0, and subjected to a cation ion purification, HiTrap® SP HP (Cytiva Life Sciences) to further remove impurities. The cation captured protein was washed with 10 mM Sodium Phosphate pH 7.0 for 10CV, then eluted in 0-30% gradient of 10 mM Sodium Phosphate pH 7.0, 1M NaCl for 50CV to separate the desired bispecific antibody or fusion protein Fc heterodimer from Fc homodimer or other contaminants with low isoelectric points (pI). Then the cation captured protein was subjected to gradient elution from 30-100% of 10 mM Sodium Phosphate pH 7.0, 1M NaCl for 10CV to separate the desired bispecific antibody or fusion protein Fc heterodimer from Fc homodimer contaminants with high isoelectric points (pI) or from aggregates. Fractions representing the desired antibody heterodimer were then pooled and dialyzed in 20 mM Histidine pH 5.8, supplemented with sucrose/tween-80, sterile filtered, and stored at 4° C. Concentration of the formulated protein was determined using UV absorbance at 280 nM (A280). Purity was assessed by analytical size-exclusion chromatography and SDS-PAGE electrophoresis. Identity of the bispecific antibody was confirmed by Mass Spec (MS).

Figure 8A:
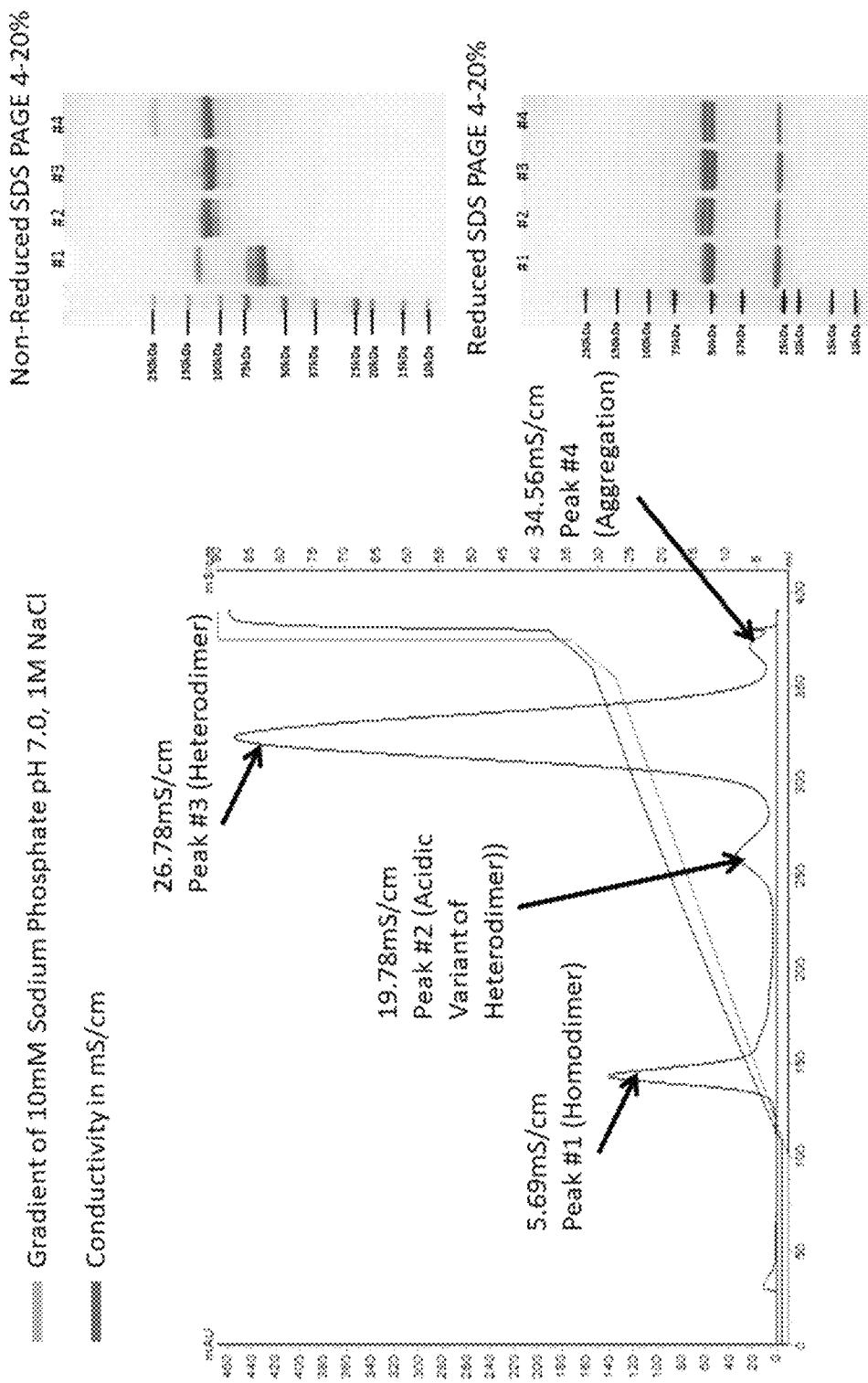
FIGS. 8A and 8B.
Figure 8B:
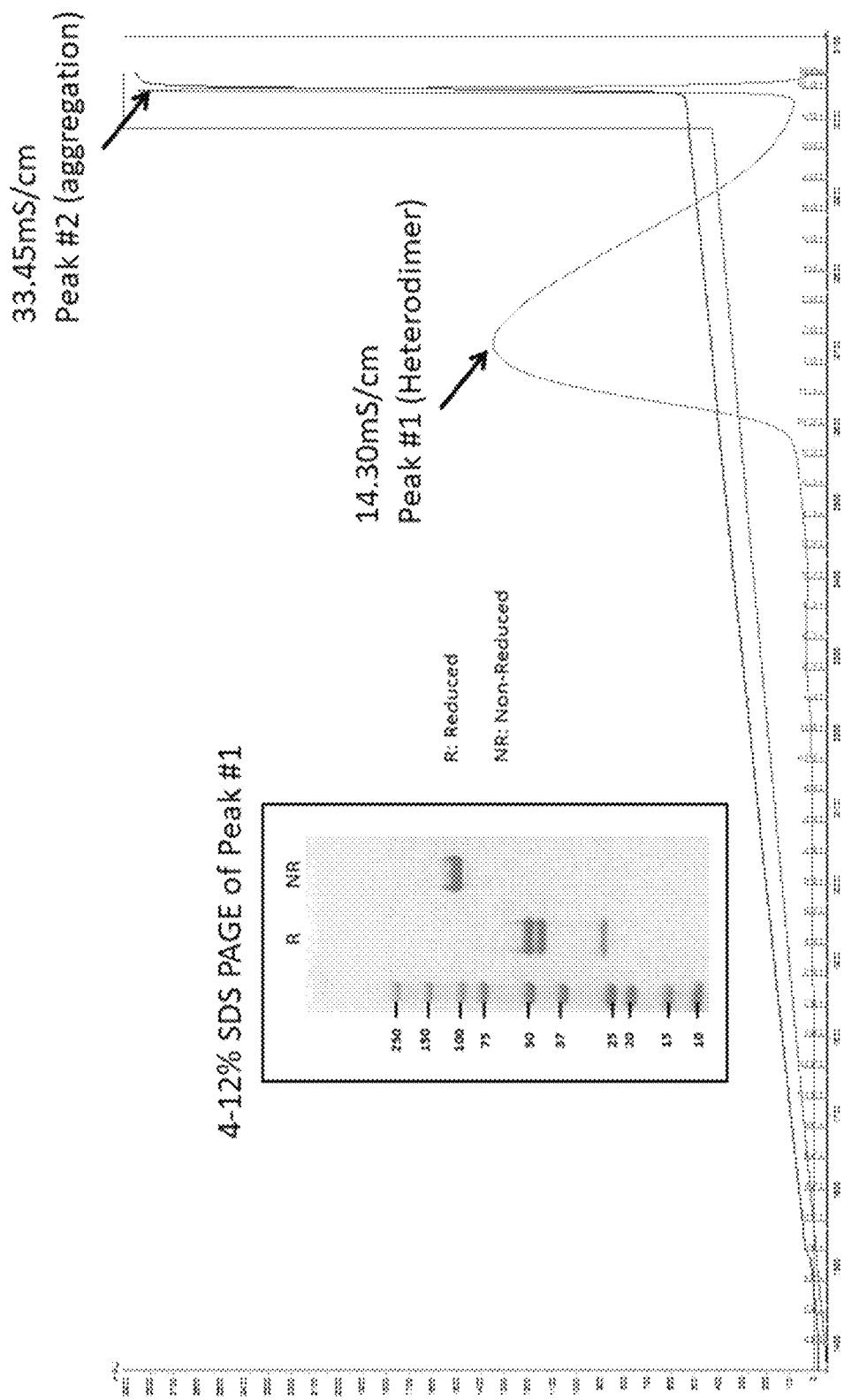

Examples of HiTrap® SP HP (Cytiva Life Sciences) cation exchange chromatography profiles and SDS-PAGE purity analysis for anti-gp120 bispecific antibodies and anti-gp120 bispecific Fc fusion proteins are shown in FIGS. 8A-8B. These results demonstrate that pure bispecific antibodies and Fc fusion proteins can be expressed and purified using the designs and methods described herein (e.g., HiTrap® SP HP (Cytiva Life Sciences) where cation exchange chromatography successfully isolated the desired bispecific antibody or fusion protein Fc heterodimer from Fc homodimer or other contaminants with low isoelectric points (pI) using a gradient of 0-30% 1M NaCl in 20 mM sodium phosphate pH 7.0).

Example 3

Engineering Humanized SP34 Antibody Variable Domains that do not Bind Protein A

Protein A affinity chromatography is commonly used to purify human IgGs for both research and therapeutic applications (Shukla, et al., J, *Chromatogr. B Analyt. Technol. Biomed. Life Sci.* (2007) 848:29-39). This method takes advantage of *Staphylococcus aureus* Protein A, which binds with high affinity to IgG1 Fc domains at neutral pH but not at acidic pH, thus allowing capture of IgGs from cellular supernatants, and elution of purified IgG using acidic buffers. In addition to its interaction with the Fc domain of IgGs, Protein A can bind to a subset of VH3 derived human variable domains. In some cases, VH3 derived antibodies may require harsher and more acidic elution buffers to be eluted from Protein A, which may destabilize the structure of the antibody, lead to aggregation and/or precipitation and reductions in overall yield. While engineered variants of Protein A, such as those used in MabSelect™ SuRe™ resin, have reduced affinity to VH3 domains, some VH3 domains are still capable of binding this resin (Bach, et al., *Journal of Chromatography A*. (2015) 1409:60-69).

In certain embodiments of the bispecific antigen binding molecules described herein, the H435R (R) or the H435R+Y436F (RF) mutation is incorporated into the CH3 domain of one heavy chain, but not the other. As a result, the bispecific heterodimer retains binding to Protein A, while one of the two possible homodimeric contaminants does not bind Protein A, and is thus eliminated during purification. However, residual Protein A binding, present in a VH3 domain fused to an H435R containing CH3 domain, could cause such a homodimeric contaminant to bind Protein A, and obviate the utility of the H435R mutation.

To minimize or eliminate residual binding of the humanized anti-CD3 VH3 domain to Protein A, we used structural modeling to design a series of single- and double-point mutants predicted to reduce or eliminate Protein A binding. A homology model of huSP34.13.18 (made using the default antibody homology modeling protocols in Discovery Studio 2017r2), a structure of Protein A bound to a VH3 domain (PDB: 1DEE), as well as the sequence of the engineered Protein A Z domain found in MabSelect™ Sure™ (Nilsson, et al., *Protein Engineering* (1987) 1:107-113) were used to generate a model of huSP34.13.8 bound to the Protein A Z domain. Next, we examined the interface between the Z domain and huSP34.13.8 in order to identify residues potentially contributing to Protein A binding. Based on this analysis, we selected residues S17, R19, T57, Y59, G65, T68, S70, Q81, N82a and S82b for further analysis. A variety of mutations at each position were initially tested for their ability to disrupt binding to Protein A in-silico using default protocols in Discovery Studio 2017r2. Mutations selected for further experimental analysis were predicted to increase the binding free energy between the Z-domain and huSP34.13.8 Fv.

We next conducted small scale Protein A purifications on huSP34.13.8 and the designed variants, all fused to an Fc containing the H435R mutation. 5 µg of the DNA encoding the scFv-Fc constructs was transfected into 5 ml of Expi293 cells according to manufacturer's protocol. Clarified supernatant of each transfection was collected 4 days post-transfection. 15 µl of supernatant was saved for gel loading. scFv-Fc protein was purified from 200 µl of supernatant using 20 µl Protein A resin in PhyTips® over Bravo Liquid Handling platform. Captured proteins on PhyTips® were washed 3× with 1×PBS prior to elution using 60 µl of 100 mM sodium acetate pH 3.7. 30 µL of each elution was fractionated over a 12-well 4-20% Criterion TGX Stain-free gel well and imaged. Relative intensity of the homodimer band of various scFv-Fc variants was quantified using Bio-Rad Image Lab™ 6.0 software. Relative binding of each variant to Protein A was normalized to the band intensity of the parental scFv (huSP34.13.8 scFv-AAS+SAV+R) and is shown in Table 11.

TABLE 11

Relative Protein A Binding of First Round huSP34.13.8scFv-Fc Variants

| Name | Amino Acid Substitutions | % normalized binding to ProA resin |
| --- | --- | --- |
| huSP34.14.8 scFv AAS + SAV + R | R19S | 0.8 |
| huSP34.15.8 scFv AAS + SAV + R | T57A | 10.9 |
| huSP34.16.8 scFv AAS + SAV + R | T57E | 0.4 |
| huSP34.17.8 scFv AAS + SAV + R | G65S | 7.9 |
| huSP34.18.8 scFv AAS + SAV + R | G65T | 6.3 |
| huSP34.19.8 scFv AAS + SAV + R | Q81E | 1.4 |
| huSP34.20.8 scFv AAS + SAV + R | Q81T | 10.5 |
| huSP34.21.8 scFv AAS + SAV + R | N82aS | 19.4 |
| huSP34.22.8 scFv AAS + SAV + R | N82aR | 1.6 |
| huSP34.23.8 scFv AAS + SAV + R | R19K, Q81E | 1.3 |
| huSP34.24.8 scFv AAS + SAV + R | Q81E, N82aS | 1.1 |
| huSP34.25.8 scFv AAS + SAV + R | T57A, G65S | 0.3 |
| huSP34.13.8 scFv AAS + SAV + R | parent | 100 |

All variants demonstrated reduced binding to Protein A, although some were much more effective and led to near complete loss of retention during Protein A chromatography. Based on these data, a series of double mutants, e.g., R19S and T57A; R19S and T57E; R19S and G65S; R19S and Q81E; T57A and Q81E; T57E and G65S; T57E and Q81E; and G65S and Q81E, were generated to further reduce or eliminate binding of the anti-CD3 binding VH domain to Protein A. Results are provided in Table 12.

TABLE 12

Protein A Binding of Second Round huSP34.13.8scFv-Fc Homodimer Variants

| Name | Amino Acid Substitutions | % normalized binding to ProA resin |
| --- | --- | --- |
| huSP34.26.8 scFv AAS + SAV + R | R19S, T57A | 0.41 |
| huSP34.27.8 scFv AAS + SAV + R | R19S, T57E | 0.29 |
| huSP34.28.8 scFv AAS + SAV + R | R19S, G65S | 0.38 |
| huSP34.29.8 scFv AAS + SAV + R | R19S, Q81E | 1.55 |
| huSP34.30.8 scFv AAS + SAV + R | T57A, Q81E | 1.75 |
| huSP34.31.8 scFv AAS + SAV + R | T57E, G65S | 1.57 |
| huSP34.32.8 scFv AAS + SAV + R | T57E, Q81E | 2.91 |
| huSP34.33.8 scFv AAS + SAV + R | G65S, Q81E | 0.31 |
| huSP34.25.8 scFv AAS + SAV + R | T57A, G65S | 0.45 |
| huSP34.13.8 scFv AAS + SAV + R | Parent | 100 |

Next, a selection of variant huSP34 scFv-Fc fusion proteins containing one or two VH region mutations along with the unmutated control were expressed at larger scale to increase the relative loading concentration on the Protein A resin and thus increase the stringency of the Protein A knockout screen. 500 ml of Expi293 cells were transfected with 0.5 mg DNA encoding selected huSP34 scFv-Fc Protein A knockout variants according to manufacturer's protocol. Four days post transfection, the cell-free clarified supernatant was collected and loaded to a MabSelect™ SuRe™ (Cytiva Life Sciences) column. Afterwards the column was washed with a low salt buffer of 25 mM Tris HCl pH 7.5, 25 mM NaCl for 10 column volumes (CV), then high salt wash of 25 mM Tris HCl pH 7.5, 500 mM NaCl for 5CV to remove non-specific binding, and finally washed with a low salt wash of 25 mM Tris HCl pH 7.5, 25 mM NaCl for 10CV. To elute the antibody, an isocratic elution step of 100 mM sodium acetate pH 3.7 was performed. The eluted pool was neutralized to pH 6.0 with 1 M Tris HCl pH 9.0, and subjected to a cation ion purification, HiTrap SP HP (Cytiva Life Sciences) to further remove impurities. The cation captured protein was washed with 10 mM sodium phosphate pH 7.0 for 10CV, then eluted in 0-30% gradient of 10 mM sodium phosphate pH 7.0, 1M NaCl for 50CV to separate the desired two targeting arm antibody (heterodimer) from the one targeted arm antibody (homodimer). Followed with gradient elution from 30-100% of 10 mM sodium phosphate pH 7.0, 1 M NaCl for 10CV to remove aggregation or homodimer in higher isoelectric point (pI). All proteins were formulated into 20 mM histidine pH 5.8 by dialysis, added additive of sucrose/tween-80, sterile filtered, and stored at 4° C. Concentration of the formulated protein was measured by A280. Purity was assessed as percent monodispersed by analytical size-exclusion chromatography. Identity of the bispecific antibody was determined by Mass Spec (MS). The three VH-region variants with the lowest residual Protein A binding, along with the parental construct were further scaled up as anti-gp120 bispecific antibodies and final yield was assessed. The results of this work are shown in Table 13.

TABLE 13

Protein A Binding of huSP34.13.8scFv-Fc Protein A Knockout Homodimer Variants

| Name | Mutant | scFv-Fc Homodimer Yield Relative to WT (e.g. Protein A binding) | PGT121.66 Bispecific Antibody Yield |
|---|---|---|---|
| huSP34.13.8 scFv AAS + SAV + R | Parent | 100% | 178 mg/L |
| huSP34.14.8 scFv AAS + SAV + R | R19S | 21% | n.d.* |
| huSP34.19.8 scFv AAS + SAV + R | Q81E | 86% | n.d. |
| huSP34.25.8 scFv AAS + SAV + R | T57A + G65S | 1% | 165 mg/L |
| huSP34.26.8 scFv AAS + SAV + R | R19S + T57A | 8% | n.d. |
| huSP34.27.8 scFv AAS + SAV + R | R19S + T57E | 8% | n.d. |
| huSP34.28.8 scFv AAS + SAV + R | R19S + G65S | 1.50% | 151 mg/L |
| huSP34.33.8 scFv AAS + SAV + R | G65S + Q81E | 0.70% | 122 mg/L |

*n.d.—not determined

The top three mutants were incorporated into the background of anti-gp120 bispecific antibodies and CD4 ECD-Fc fusions built around the huSP34.3.13 variant. BLI and SPR analysis confirmed that these mutations did not impact anti-CD3 affinity (Examples 6), however BVP (Example 7) and PK analysis revealed distinct differences among the various bispecific antibodies tested (Example 13).

Example 4

Expression, Purification and Biophysical Assessment of huSP34 Fab and IgG Variants For Fab production, the VH coding sequences of mSP34, huSP34 variants and comparator molecules were codon-optimized for *Homo sapiens* expression and cloned into pcDNA3.1 vector containing CH1 domain of human IgG1 followed by a C-terminal His8-FLAG tag (His8 or HHHHHHHH disclosed as SEQ ID NO: 1041). Codon-optimized VL sequences were cloned into pcDNA3.1 vector with CL domain of human lambda light chain. Expi293 cells transfection was conducted according to manufacturer's protocol. One microgram total DNA was used per ml of transfection. Expression vectors encoding the heavy and light chain were mixed in a DNA ratio of 2:3 (w:w) respectively before addition to diluted Expifectamine reagent. After incubation at room temperature for 20 minutes, the DNA transfection complex was added to Expi293 cells at 3 million per ml. Four days post-transfection, the clarified supernatant was harvested. Fabs were purified using Ni-IMAC PhyTips® on Hamilton Star Liquid Handling platform. Fabs bound were eluted from Ni-IMAC resin with 250 mM imidazole-containing 25 mM Tris, pH 8 and 300 mM NaCl and quantified by absorbance measurement at A280 using Nanodrop after blanking with elution buffer. Concentration of each Fab recovered was determined by dividing the A280 reading with the respective extinction coefficient. Expression titer (mg/L) was calculated as follows: [(Concentration (mg/ml)×volume of eluate (ml)*1000]/30 ml. The expression titers of mSP34 and comparator #6 were 58 mg/L and 128 mg/L respectively, while the value for the first round of huSP34 Fabs is shown in Table 14. Heavy chains 6 and 8 were associated with huSP34 variants that had the highest levels of expression.

TABLE 14

Expression Titer of First Round huSP34 Fabs in mg/L

|  | HC1 | HC2 | HC3 | HC4 | HC5 | HC6 | HC7 | HC8 | HC9 | HC10 |
|---|---|---|---|---|---|---|---|---|---|---|
| LC1 | 114 | 102 | 60 | 85 | 94 | 179 | 97 | 168 | 95 | 15 |
| LC2 | 92 | 147 | 67 | 78 | 47 | 154 | 101 | 165 | 115 | 85 |
| LC3 | 82 | 93 | 90 | 87 | 96 | 113 | 97 | 208 | 115 | 122 |
| LC4 | 97 | 97 | 92 | 88 | 73 | 108 | 43 | 141 | 69 | 100 |
| LC5 | 91 | 105 | 85 | 74 | 76 | 140 | 80 | 104 | 66 | 81 |
| LC6 | 97 | 105 | 87 | 92 | 79 | 97 | 88 | 82 | 76 | 87 |

Based in part on these results, a second round of humanized SP34 variants was designed. The expression titers of comparator #1 and comparator #5 Fabs were 80 mg/mL and 184 mg/mL respectively, while the values for the second round of huSP34 Fabs is shown in Table 15. Heavy chains 12 and 13 were associated with the highest expression titers, while heavy chain 3 was associated with the lowest expression titers.

TABLE 15

Expression Titer of Second Round huSP34 Fabs in mg/L

|  | HC3 | HC11 | HC12 | HC13 |
|---|---|---|---|---|
| LC7 | 105 | 124 | 137 | 137 |
| LC8 | 87 | 107 | 133 | 118 |
| LC9 | 95 | 116 | 143 | 154 |
| LC10 | 78 | 96 | 112 | 108 |

For production of huSP34 variants as human IgG1 antibodies, the VH and VL coding sequences of humanized SP34 variants were cloned into pcDNA3.1 vector containing immunoglobulin isotype 1 Fc and human lambda constant region sequence respectively. Transfection of Expi293 cells was performed according to manufacturer's protocol. One (1) microgram total DNA was used per ml of transfection. The DNA was combined in a ratio of 60% LC to 40% HC with diluted Expifectamine® reagent before addition to cells. Four days post-transfection, the cell-free culture media was purified using MabSelect™ SuRe™ resin embedded PhyTips® on Hamilton Star Liquid Handling platform. Bound IgG was eluted from the tips using 100 mM sodium acetate pH 3.7 and neutralized by the addition of $\frac{1}{10}$th volume of 1M Tris pH 9.0. Eluted IgG was quantified by absorbance measurement at A280 using Nanodrop after blanking with elution buffer. Concentration of each IgG recovered was determined by dividing the A280 reading with the respective extinction coefficient. Expression titer (mg/L) was calculated as follows: [(Concentration (mg/ml)× volume of eluate (ml)*1000]/30 ml (transfected volume).

The expression titer of huSP34 IgG1 variants (n=1) is shown in Table 16. All huSP34 IgG1 variants show reduced expression titer relative to comparator #1 (121 mg/L, n=2).

TABLE 16

Expression Titer of huSP34 IgGs in mg/L

|  | HC1 | HC2 | HC4 | HC3 | HC11 | HC12 | HC13 |
|---|---|---|---|---|---|---|---|
| LC1 | 72 | 74 | 117 | 125 | n.d.* | n.d. | n.d. |
| LC3 | 100 | 168 | 147 | 103 | n.d. | n.d. | n.d. |
| LC6 | 93 | 134 | 125 | 115 | n.d. | n.d. | n.d. |
| LC7 | n.d. | n.d. | n.d. | 135 | 69 | 126 | 143 |
| LC8 | n.d. | n.d. | n.d. | 47 | 103 | 87 | 108 |
| LC9 | n.d. | n.d. | n.d. | 100 | 140 | 108 | 156 |
| LC10 | n.d. | n.d. | n.d. | 98 | 74 | 58 | 69 |

*n.d. not determined

Purified huSP34 variant samples were analyzed via analytical size exclusion chromatography (SEC) to determine aggregate levels. All analyses were run on an Agilent 1200 HPLC system using a Shodex LW-803, 8×300 mm, 3-micron column. The resin within the column has spherical beads containing pores of a specific size distribution. Separation occurs when molecules of different sizes are included or excluded from the pores within the matrix. The mobile phase was 200 mM $KPO_4$, 25 mM KCl, pH 6.0, and the column was run at a 0.5 mL/min flow rate. Protein detection was accomplished via OD280 detection, and a calibration run was performed using Bio-Rad SEC standards to ensure correct separation of proteins with different molecular weights. A nominal injection amount was set at 20 µs of test protein and the total area of each eluted protein-containing peak was calculated. From these data, the SEC purity of each sample was defined as the percentage of monomeric Fab material, this calculated by dividing the area of the monomer-containing peak by the combined area of this peak plus any earlier-eluting aggregate-containing peaks (no later eluting peaks containing protein were observed).

The average (n=2) SEC purity for mSP34 and comparator #6 were 81% and 84% respectively, while the value (n=1) for each huSP34 Fab is shown in Table 17. The SEC purity of the first round huSP34 Fabs ranged from 75% to 92%. Heavy chains 1, 2, 4, 5 and 8 were associated with the lowest levels of aggregation, while light chain 6 was associated with the highest levels of aggregation. Interestingly, heavy chain 2 (HC2) was associated with the lowest levels of aggregation when paired with all light chain variants tested.

TABLE 17

SEC Purity (%) of First Round huSP34 Fabs.

|  | HC1 | HC2 | HC3 | HC4 | HC5 | HC6 | HC7 | HC8 | HC9 | HC10 |
|---|---|---|---|---|---|---|---|---|---|---|
| LC1 | 89 | 89 | 78 | 86 | 87 | 83 | 84 | 90 | 80 | n.d |
| LC2 | 90 | 92 | 85 | 87 | 87 | 86 | 87 | 89 | 86 | 80 |
| LC3 | 83 | 85 | 81 | 84 | 85 | 83 | 85 | 87 | 86 | 83 |
| LC4 | 83 | 85 | 82 | 81 | 82 | 82 | 77 | 82 | 79 | 83 |
| LC5 | 84 | 89 | 85 | 84 | 75 | 84 | 77 | 85 | 75 | 82 |
| LC6 | 79 | 85 | 79 | 83 | 78 | 84 | 81 | 79 | 82 | 81 |

*n.d. = not determined

The SEC results for the second round of huSP34 Fabs are shown in Table 18. All second round huSP34 Fabs show improved % monodispersion values when compared to the first round huSP34 Fabs and were similar to the comparator #5 (97.4%) Fab.

TABLE 18

SEC Purity (%) of Second Round huSP34 Fabs.

|  | HC3 | HC11 | HC12 | HC13 |
|---|---|---|---|---|
| LC7 | 98.1 | 97.1 | 97.7 | 97.2 |
| LC8 | 97.7 | 97.7 | 97.5 | 97.1 |
| LC9 | 97.3 | 97.6 | 98 | 97.2 |
| LC10 | 97.4 | 96.9 | 96.8 | 96.9 |

The SEC results for the huSP34 IgG1 molecules are shown in Table 19. All of the huSP34 IgG1 antibodies displayed a high degree of purify with aggregation levels <6%. Heavy chain 3 (HC3) is associated with the lowest levels of aggregation.

TABLE 19

SEC Purity (%) of huSP34 IgGs

|  | HC1 | HC2 | HC4 | HC3 | HC11 | HC12 | HC13 |
|---|---|---|---|---|---|---|---|
| LC1 | 96.0 | 94.5 | 94.8 | 96.6 | n.d.* | n.d. | n.d. |
| LC3 | 95.7 | 95.0 | 94.4 | 96.6 | n.d. | n.d. | n.d. |
| LC6 | 94.6 | 95.2 | 93.5 | 95.3 | n.d. | n.d. | n.d. |
| LC7 | n.d. | n.d. | n.d. | 97.3 | n.d | 96.2 | 95.3 |
| LC8 | n.d. | n.d. | n.d. | 95.8 | 96.4 | 95.8 | 96.1 |
| LC9 | n.d. | n.d. | n.d. | 96.1 | 97.4 | 95.1 | 96.5 |
| LC10 | n.d. | n.d. | n.d. | 96.9 | 96.5 | 94.4 | 96.1 |

*n.d. = not determined

To determine the charge heterogeneity of purified huSP34 Fabs and identify any mutations associated with potential sequence liabilities, we conducted strong cation exchange chromatography. All analysis was run on an Agilent 1200 HPLC system using a MabPac™ SCX 4×50 mm, 5 µm strong cation exchange column (Thermo Scientific) at 30° C. A short analytical scale CX-1 method was run according to the manufacture's guidelines using their proprietary mobile phase known as "CX-1 pH gradient buffer" which is designed to generate a linear pH. The buffers were provided as a 10× concentrate and diluted at the time of use with deionized sterile water. Buffer A is pH 5.6; Buffer B is pH 10.2. A nominal injection amount was set at 20 µs of test protein.

The following gradient was used: 0-1 min at 0.5 ml/min 0% B, 1-16 min 0-100% B, 18.7-19.5 min 0% B, 23 min 0% B. When the resulting OD280 vs volume chromatograph has a correctly drawn baseline, the protein peaks can be correctly annotated. From the chromatographic profile for each sample, the total area of each peak was calculated and the percentage of the main peak relative to total (% main peak) was determined. Impurities in humanized SP34 samples were predominantly earlier eluting than the main peak and were thus considered acidic in nature.

Figure 9:
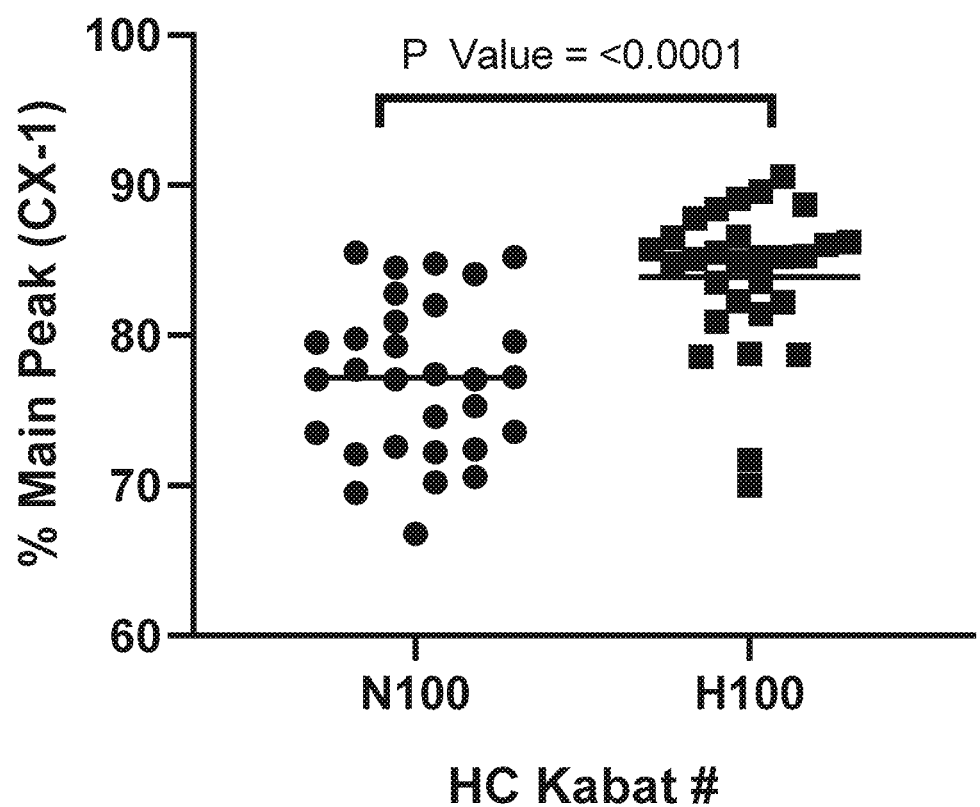
FIG. 9 illustrates the analytical CX-1% main peak values for all round 1 huSP34 Fab variants. The variants containing asparagine (N) at heavy chain (HC) position 100 were compared with those containing histidine at heavy chain position 100 using an unpaired t test. The results suggest that H100 contributed significantly to improved charge homogeneity.

The percent main peak of each huSP34 Fab obtained from the analytical CX-1 analysis is presented in Table 20. The values for the first round huSP34 Fabs ranged from 66.8% to 90.6%, while the mSP34 Fab gave a value of 90.9% and comparator #6 gave a value of 83.1%. Fabs having heavy chain 6 (HC6) had substantially lower percent main peak than the other heavy chains, while Fabs containing heavy chain 4 (HC4) had the highest percent main peak. To identify mutations associated with reduced acidic species (higher percentage in the main peak), we next compared the dataset in Table 20, with the heavy chain variable domain sequences shown in FIG. 4B. Pairwise comparisons, sequence liability analysis and structural analysis were used to identify mutations that play a role in huSP34 charge heterogeneity. Heavy chain residues showing strong associations with higher percent main peak values include S30, D73, V89 and H100, while N30, N73, M89 and N100 were associated with reduced main peak values and an increase in acidic variants. Among these residues, H100 appeared most strongly associated with reduced levels of acidic variants (FIG. 9), consistent with the prediction that it removes a solvent exposed deamidation motif at the tip of heavy chain CDR3 (FIGS. 1-2). Based on this analysis, D73 and H100 were held constant during the second round of humanization.

The huSP34 IgG molecules were also analyzed using analytical scale CX-1 ion exchange, and the results are shown in Table 22. The results align with those of the huSP34 Fabs, demonstrating that variants from the second round of humanization (HC3, HC11-13 and LC7-10) demonstrate significant improvements in product homogeneity when compared to variants from the first round of humanization (HC1-4 and LC1-6).

TABLE 22

Percent Main Peak, CX-1 Ion Exchange Analysis of huSP34 IgGs

| | HC1 | HC2 | HC4 | HC3 | HC11 | HC12 | HC13 |
|---|---|---|---|---|---|---|---|
| LC1 | 76.3 | 84.6 | 82.3 | 79.9 | n.d.* | n.d. | n.d. |
| LC3 | 78.2 | 82.1 | 85.2 | 80.1 | n.d. | n.d. | n.d. |
| LC6 | 89.9 | 80.1 | 79.7 | 88.2 | n.d. | n.d. | n.d. |
| LC7 | n.d. | n.d. | n.d. | 86.8 | 93.4 | 88.2 | 89.2 |
| LC8 | n.d. | n.d. | n.d. | 89.9 | 86.5 | 86.6 | 86.1 |
| LC9 | n.d. | n.d. | n.d. | 90.4 | 87.1 | 86.2 | 85.8 |
| LC10 | n.d. | n.d. | n.d. | 87.7 | 82.3 | 83.6 | 86.3 |

*n.d. = not determined

To characterize the thermodynamic stability of huSP34 variants we assessed the experimental thermal melting point

TABLE 20

Percent Main Peak, CX-1 Ion Exchange Analysis of First Round huSP34 Fab.

| | HC1 | HC2 | HC3 | HC4 | HC5 | HC6 | HC7 | HC8 | HC9 | HC10 |
|---|---|---|---|---|---|---|---|---|---|---|
| LC1 | 74.6 | 79.5 | 83.6 | 86.0 | 84.8 | 70.6 | 84.5 | 71.7 | 85.2 | n.d.* |
| LC2 | 80.9 | 85.5 | 89.6 | 90.6 | 88.7 | 73.6 | 82.8 | 87.8 | 75.3 | 70.0 |
| LC3 | 73.5 | 77.1 | 80.9 | 85.7 | 84.9 | 72.2 | 84.8 | 86.2 | 79.8 | 85.2 |
| LC4 | 72.1 | 77.2 | 81.4 | 86.6 | 83.5 | 69.5 | 77.7 | 78.6 | 77.4 | 85.2 |
| LC5 | 77.1 | 84.1 | 85.5 | 89.1 | 78.8 | 70.2 | 72.6 | 88.4 | 72.4 | 82.3 |
| LC6 | 82.0 | 77.1 | 85.3 | 86.5 | 78.7 | 66.8 | 79.3 | 85.1 | 79.6 | 82.2 |

*n.d. = not determined

The analytical scale CX-1 results for the second round of huSP34 Fabs are shown in Table 21. Many of the second round huSP34 Fabs show improved % main peak values when compared to the first round huSP34 Fabs and were more similar to the comparator #5 (99.3%) Fab. Heavy chain 3 was associated with the highest percent main peak values, with the exception of the HC3+LC7 pair which was among the lowest.

TABLE 21

Percent Main Peak, CX-1 Ion Exchange Analysis of Second Round huSP34 Fabs

| | HC3 | HC11 | HC12 | HC13 |
|---|---|---|---|---|
| LC7 | 89.9 | 92.7 | 91.3 | 90.6 |
| LC8 | 92.4 | 90.4 | 90.8 | 90.8 |
| LC9 | 93.4 | 90.8 | 91.1 | 90.1 |
| LC10 | 92.2 | 90.3 | 91.1 | 91.1 | and the onset of aggregation of the purified Fabs using the UNcle system (Unchained Labs) in a single analytical process. A 9 μl protein sample was prepared in triplicate in formulation buffer (95 mM NaAcetate 50 mM Tris, pH 6.0) at a concentration between 0.1-150 mg/ml. The protocol used for this analysis has a thermal ramp set to 0.4° C./min. The determination of Tm is achieved through fluorescent detection and Tagg is achieved through static light scatter detection. The resulting chromatograph of unfolding fluorescence shift and static light scatter versus the change in temperature is defined by algorithmic analysis and yield the Tm inflection point and the onset of aggregation is the Tagg.

The results of the Tm analysis for the first round huSP34 Fab variants are shown in Table 23. All first round Fabs showed improved thermodynamic stability compared to the mSP34 Fab (60.1° C.) and comparator #6 (58.8° C.), suggesting that the structure-guided humanization approach led to significant improvements in thermodynamic stability for the huSP34 variants tested herein.

TABLE 23

Melting Temperature (Tm) in ° C. Determined for the First Round huSP34 Fabs

|     | HC1  | HC2  | HC3  | HC4  | HC5  | HC6  | HC7  | HC8  | HC9  | HC10  |
|-----|------|------|------|------|------|------|------|------|------|-------|
| LC1 | 67.5 | 67.6 | 68.1 | 68.4 | 67.6 | 67.0 | 67.0 | 66.1 | 65.7 | n.d.* |
| LC2 | 67.4 | 67.2 | 67.7 | 67.6 | 67.0 | 67.6 | 66.9 | 66.4 | 65.6 | 65.1  |
| LC3 | 68.1 | 67.8 | 67.9 | 67.9 | 67.0 | 67.8 | 73.4 | 66.0 | 65.3 | 65.5  |
| LC4 | 67.0 | 67.5 | 67.6 | 67.5 | 67.1 | 67.1 | 65.0 | 65.5 | 64.6 | 65.2  |
| LC5 | 66.8 | 66.4 | 67.5 | 66.3 | 65.5 | 66.5 | 64.8 | 64.9 | 64.3 | 64.8  |
| LC6 | 62.2 | 67.2 | 64.0 | 65.1 | 65.5 | 65.6 | 64.4 | 64.2 | 63.3 | 63.8  |

*n.d. = not determined

The results of the Tagg analysis for the first round huSP34 Fab variants are shown in Table 24. Many of the first round huSP34 Fabs showed reduce aggregation propensity compared to the mSP34 Fab (57.7° C.) and comparator #6 (54.3° C.), suggesting that the structure-guided humanization approach led to improvements in thermodynamic stability for the huSP34 variants tested herein. Surprisingly, HC3, which showed relatively high levels of aggregate content in the SEC analysis (Table 17), showed the lowest aggregation propensity in the Tagg analysis presented in Table 24.

TABLE 24

Aggregation Temperature (Tagg) in ° C. Determined for the First Round huSP34 Fabs

|     | HC1  | HC2  | HC3  | HC4  | HC5  | HC6  | HC7  | HC8  | HC9  | HC10 |
|-----|------|------|------|------|------|------|------|------|------|------|
| LC1 | 61.8 | 61.9 | 63.5 | 62.0 | 61.4 | 61.4 | 61.9 | 60.7 | 59.4 | 43.2 |
| LC2 | 61.8 | 61.6 | 62.4 | 62.4 | 62.5 | 62.0 | 62.6 | 61.4 | 60.5 | 60.1 |
| LC3 | 62.3 | 62.0 | 61.9 | 61.9 | 60.7 | 61.8 | 62.0 | 61.2 | 60.0 | 58.9 |
| LC4 | 61.6 | 61.5 | 61.7 | 60.9 | 61.0 | 61.6 | 62.6 | 59.8 | 60.0 | 59.3 |
| LC5 | 61.3 | 60.9 | 62.0 | 60.4 | 59.8 | 60.8 | 61.0 | 59.9 | 59.5 | 59.8 |
| LC6 | 57.4 | 61.6 | 58.4 | 59.6 | 59.0 | 61.4 | 61.0 | 58.3 | 58.2 | 49.4 |

Example 5

CD3 Affinity Screening Using Biolayer Interferometry (BLI)

The CD3 binding kinetics of the purified huSP34 Fabs were determined using OctetRed384 (Pall ForteBio, CA) biolayer interferometry (BLI). Samples or buffer were dispensed into polypropylene 384-well black flat bottom plates (Greiner, Germany 781209) at a volume of 100 μl per well and all measurements were performed at 30° C. with agitation at 1000 rpm. Streptavidin (SA) coated biosensors tips (Pall ForteBio, CA) were used to capture biotinylated CD3 epsilon: delta heterodimer and typical immobilization levels captured on the SA sensors were 1 nm which approximately translates to 300 ng/ml of captured protein. For kinetic measurements biosensors were first pre-wetted with assay buffer for 10 minutes to remove protective sucrose coating followed by the recommended regeneration conditions for standardization of the biosensor surface for the experiment. In order to load the biosensors with antigen, 300 ng/ml of biotinylated CD3 epsilon: delta heterodimer protein (Amsbio AMS.CDD-H52WO) was immobilized on the SA sensor for 900 seconds. The CD3 loaded biosensors were then blocked with 20 ug/ml biocytin (sigma) for 200 seconds and then dipped into assay buffer containing wells for 200 seconds to remove any non-specific protein or unbound CD3 heterodimer.

CD3 loaded and biocytin blocked biosensors were then transferred into fresh assay buffer for 200 seconds to collect a baseline read. Kinetic measurements for anti-CD3 Fab and bispecific antibody binding were performed by dipping the CD3-coated biosensors into wells containing multiple concentrations of Fab or Ab (0-300 nM) for 100 seconds followed by a 300 second dissociation time by transferring the biosensors into assay buffer containing wells. The CD3 loaded sensors were then regenerated for the next kinetic measurement. Biosensors were generated by removing bound Fabs or Ab from immobilized CD3 on SA biosensors. Regeneration conditions used consisted of 3 cycles of 5 seconds of dipping the biosensors in Regeneration Buffer (10 mM Glycine HCl pH 1.5) followed by Assay Buffer (10 mM sodium phosphate pH 7.4, 140 mM Sodium Chloride, 0.005% Tween20 with 0.2% BSA).

All sensorgrams were referenced for buffer effects and fitted to an one-site binding model using Octet Data Analysis Software V.11 (Pall ForteBio, CA) generating affinity values for association ($k_{on}$), dissociation ($k_{off}$) rate constants and the equilibrium dissociation constant ($K_D$).

The results for the first round huSP34 Fabs and relevant comparators are shown in Table 25. All first round huSP34 Fabs shows reduced affinity relative to the mSP34 Fab and comparator #6. However, comparing this dataset with the sequences shown in FIG. 3 revealed numerous SAR relationships, including residues predicted to improve the affinity of huSP34 as well as human residues that could be incorporated in or directly adjacent to the mSP34 CDRs without negatively impacting functional properties. Heavy chain residues T31, I51, D73, and Y102 were all associated with variants that had higher affinity. Heavy chain residues S30 (CDR1) and G49 (adjacent to CDR2) appeared to have no impact on affinity when incorporated in huSP34 variants, but both increased the match of huSP34 variants to the human germline. Residue S30 was also associated with improvements to the analytical CX-1 percent main peak values. Surprisingly, heavy chain residues H100, which was strongly associated with improved charge heterogeneity (FIG. 9), did not have a negative impact on CD3 affinity despite being in the center of CDR H3 (FIG. 1). Light chain residues had the most pronounced impact on affinity, with N52, K53, G57, V58 and N94 being associated with huSP34 variants that had improved affinity. Heavy chain 13 (HC13) and light chain 10 (LC10) were associated with the highest affinity second round huSP34 variants.

TABLE 25

Humanization of mSP34 - Round 1: Affinity Determined by BLI (Octet)

| Ab Name | $K_D$ (nM) | $k_{on}$ (M$^{-1}$ s$^{-1}$) | $k_{off}$ (s$^{-1}$) |
|---|---|---|---|
| Comparator #6 Fab-HF | 7.1 | 3.49E+05 | 2.44E−03 |
| mSP34 Fab-HF | 9.6 | 2.62E+05 | 2.50E−03 |
| huSP34.1.1 Fab-HF | 13.1 | 2.29E+05 | 3.01E−03 |
| huSP34.1.2 Fab-HF | 24.9 | 3.11E+05 | 7.62E−03 |
| huSP34.1.3 Fab-HF | 12.9 | 3.08E+05 | 3.98E−03 |
| huSP34.1.4 Fab-HF | 59.7 | 4.82E+05 | 2.86E−02 |
| huSP34.1.5 Fab-HF | 80.7 | 2.47E+05 | 1.98E−02 |
| huSP34.1.6 Fab-HF | 15.5 | 2.30E+05 | 3.53E−03 |
| huSP34.2.1 Fab-HF | 24.6 | 2.46E+05 | 5.96E−03 |
| huSP34.2.2 Fab-HF | 26.4 | 6.09E+05 | 1.41E−02 |
| huSP34.2.3 Fab-HF | 16.9 | 4.34E+05 | 7.30E−03 |
| huSP34.2.4 Fab-HF | 99.4 | 3.98E+05 | 3.35E−02 |
| huSP34.2.5 Fab-HF | 162 | 2.51E+05 | 4.08E−02 |
| huSP34.2.6 Fab-HF | 30.6 | 3.51E+05 | 1.07E−02 |
| huSP34.3.1 Fab-HF | 14.7 | 2.52E+05 | 3.66E−03 |
| huSP34.3.2 Fab-HF | 25.4 | 3.81E+05 | 9.52E−03 |
| huSP34.3.3 Fab-HF | 16.4 | 2.66E+05 | 4.37E−03 |
| huSP34.3.4 Fab-HF | 85.8 | 2.87E+05 | 2.46E−02 |
| huSP34.3.5 Fab-HF | 68.5 | 2.60E+05 | 1.77E−02 |
| huSP34.3.6 Fab-HF | 18.9 | 2.66E+05 | 4.82E−03 |
| huSP34.4.1 Fab-HF | 19.8 | 3.96E+05 | 7.23E−03 |
| huSP34.4.2 Fab-HF | 45.2 | 3.21E+05 | 1.44E−02 |
| huSP34.4.3 Fab-HF | 29.6 | 2.96E+05 | 8.68E−03 |
| huSP34.4.4 Fab-HF | 159 | 2.74E+05 | 4.36E−02 |
| huSP34.4.5 Fab-HF | 211 | 2.41E+05 | 5.06E−02 |
| huSP34.4.6 Fab-HF | 22.7 | 4.51E+05 | 1.01E−02 |
| huSP34.5.1 Fab-HF | 123 | 3.11E+05 | 3.65E−02 |
| huSP34.5.2 Fab-HF | 1200 | 9.08E+04 | 1.09E−01 |
| huSP34.5.3 Fab-HF | 539 | 1.35E+05 | 7.29E−02 |
| huSP34.5.4 Fab-HF | 497 | 4.29E+05 | 2.13E−01 |
| huSP34.5.5 Fab-HF | 666 | 2.77E+05 | 1.85E−01 |
| huSP34.5.6 Fab-HF | 268 | 2.80E+05 | 7.46E−02 |
| huSP34.6.1 Fab-HF | 53.9 | 4.78E+05 | 1.99E−02 |
| huSP34.6.2 Fab-HF | 351 | 1.44E+05 | 4.99E−02 |
| huSP34.6.3 Fab-HF | 150 | 1.89E+05 | 2.72E−02 |
| huSP34.6.4 Fab-HF | 570 | 3.59E+05 | 2.02E−01 |
| huSP34.6.5 Fab-HF | 353 | 2.73E+05 | 9.63E−02 |
| huSP34.6.6 Fab-HF | 75.0 | 4.64E+05 | 2.92E−02 |
| huSP34.7.1 Fab-HF | 372 | 2.35E+05 | 8.55E−02 |
| huSP34.7.2 Fab-HF | 498 | 3.18E+05 | 1.55E−01 |
| huSP34.7.3 Fab-HF | 365 | 2.40E+05 | 7.43E−02 |
| huSP34.7.4 Fab-HF | 4180 | 2.65E+05 | 4.24E−01 |
| huSP34.7.5 Fab-HF | 1460 | 3.07E+05 | 8.48E−01 |
| huSP34.7.6 Fab-HF | 425 | 4.03E+05 | 1.70E−01 |
| huSP34.8.1 Fab-HF | 443 | 1.86E+05 | 8.23E−02 |
| huSP34.8.2 Fab-HF | 3440 | 1.72E+05 | 9.82E−02 |
| huSP34.8.3 Fab-HF | 285 | 2.80E+05 | 7.99E−02 |
| huSP34.8.4 Fab-HF | 305 | 5.61E+05 | 1.63E−01 |
| huSP34.8.5 Fab-HF | 234 | 9.58E+05 | 2.19E−01 |
| huSP34.8.6 Fab-HF | 375 | 3.67E+05 | 1.38E−01 |
| huSP34.9.1 Fab-HF | 417 | 1.87E+05 | 7.79E−02 |
| huSP34.9.2 Fab-HF | 761 | 1.92E+05 | 1.45E−01 |
| huSP34.9.3 Fab-HF | 349 | 1.87E+05 | 6.51E−02 |
| huSP34.9.4 Fab-HF | 6120 | 4.09E+04 | 2.50E−01 |
| huSP34.9.5 Fab-HF | NBD** | NBD | NBD |
| huSP34.9.6 Fab-HF | 289 | 5.82E+05 | 1.69E−01 |
| huSP34.10.1 Fab-HF | NBD | NBD | NBD |
| huSP34.10.2 Fab-HF | 307 | 2.25E+05 | 6.64E−02 |
| huSP34.10.3 Fab-HF | 264 | 2.40E+05 | 6.33E−02 |
| huSP34.10.4 Fab-HF | NBD | NBD | NBD |
| huSP34.10.5 Fab-HF | 222 | 2.22E−07 | 8.27E−02 |
| huSP34.10.6 Fab-HF | 314 | 3.14E−07 | 1.57E−01 |

*Results represent the average of two independent runs
**NBD = no binding detected.

The results for the second round huSP34 Fabs and relevant comparators are shown in Table 26. Many of the second round huSP34 Fabs show improved affinity relative to the first round huSP34 Fabs and comparator molecules.

TABLE 26

Humanization of mSP34 - Round 2: Affinity Determined by BLI (Octet)

| Name | $K_D$ (nM) | $k_{on}$ (M$^{-1}$ s$^{-1}$) | $k_{off}$ (s$^{-1}$) |
|---|---|---|---|
| huSP34.3.7 Fab-HF | 5.6 | 3.23E+05 | 1.68E−03 |
| huSP34.3.8 Fab-HF | 4.4 | 2.55E+05 | 1.13E−03 |
| huSP34.3.9 Fab-HF | 3.5 | 6.32E+05 | 2.21E−03 |
| huSP34.3.10 Fab-HF | 2.0 | 6.83E+05 | 1.37E−03 |
| huSP34.11.7 Fab-HF | 3.6 | 6.13E+05 | 2.12E−03 |
| huSP34.11.8 Fab-HF | 2.8 | 6.10E+05 | 1.65E−03 |
| huSP34.11.9 Fab-HF | 3.4 | 8.98E+05 | 2.84E−03 |
| huSP34.11.10 Fab-HF | 2.8 | 6.97E+05 | 1.92E−03 |
| huSP34.12.7 Fab-HF | 2.7 | 9.66E+05 | 2.44E−03 |
| huSP34.12.8 Fab-HF | 3.4 | 4.93E+05 | 1.66E−03 |
| huSP34.12.9 Fab-HF | 3.2 | 1.04E+06 | 3.35E−03 |
| huSP34.12.10 Fab-HF | 4.2 | 5.01E+05 | 2.05E−03 |
| huSP34.13.7 Fab-HF | 2.8 | 1.01E+06 | 2.75E−03 |
| huSP34.13.8 Fab-HF | 2.5 | 9.33E+05 | 2.16E−03 |
| huSP34.13.9 Fab-HF | 2.7 | 1.38E+06 | 3.61E−03 |
| huSP34.13.10 Fab-HF | 1.7 | 1.36E+06 | 2.04E−03 |
| huSP34.1.3 Fab-HF | 4.3 | 1.36E+06 | 4.97E−03 |
| mSP34 Fab-HF v2 | 5.2 | 5.32E+05 | 2.66E−03 |
| Comparator #5 Fab-HF | 4.7 | 4.91E+05 | 2.31E−03 |
| huSP34.8.5 Fab-HF | NBD** | NBD | NBD |

*Results represent the average of two independent runs
**NBD = no binding detected.

The results for the third round huSP34 Fabs and relevant comparators are shown in Table 27. A range of affinity variants were explored.

TABLE 27

Humanization of mSP34 - Round 3: CD3 Affinity Determined by BLI (Octet)

| Ab Name | $K_D$(nM) | $k_{on}$ (M$^{-1}$ s$^{-1}$) | $k_{off}$ (s$^{-1}$) |
|---|---|---|---|
| huSP34.1.3 Fab-HF | 3.8 | 6.03E+05 | 2.30E−03 |
| huSP34.3.8 Fab-HF | 1.9 | 1.31E+05 | 2.40E−04 |
| huSP34.3.10 Fab-HF | 2.3 | 1.42E+05 | 2.35E−04 |
| huSP34.34.10 Fab-HF | 4.0 | 1.55E+05 | 3.03E−04 |
| huSP34.34.14 Fab-HF | 3.9 | 3.45E+05 | 1.26E−03 |
| huSP34.34.15 Fab-HF | 14.7 | 1.09E+05 | 1.50E−03 |
| huSP34.34.12 Fab-HF | 8.1 | 1.89E+05 | 1.40E−03 |
| huSP34.34.6 Fab-HF | 8.0 | 4.49E+05 | 3.57E−03 |
| huSP34.35.10 Fab-HF | 224 | 3.39E+05 | 7.59E−02 |
| huSP34.34.16 Fab-HF | 28.8 | 2.08E+05 | 5.99E−03 |
| huSP34.35.14 Fab-HF | 162 | 3.97E+07 | 1.16E−01 |
| huSP34.34.17 Fab-HF | 29.9 | 2.73E+05 | 8.16E−03 |
| huSP34.35.15 Fab-HF | 303 | 5.60E+05 | 1.70E−01 |
| huSP34.34.18 Fab-H | 87.1 | 2.57E+05 | 2.24E−02 |
| huSP34.35.12 Fab-H | 125 | 2.08E+06 | 1.03E−01 |
| huSP34.35.6 Fab-HF | 178 | 1.55E+05 | 1.87E−01 |
| huSP34.36.10 Fab-HF | 5.8 | 1.60E+06 | 9.29E−03 |
| huSP34.37.10 Fab-HF | 16.1 | 1.71E+05 | 2.67E−03 |
| huSP34.3.13 Fab-HF | 6.2 | 2.18E+05 | 1.29E−03 |
| huSP34.3.19 Fab-HF | 9.9 | 1.93E+05 | 1.64E−03 |
| huSP34.34.3 Fab-HF | 18.3 | 2.44E+05 | 4.10E−03 |
| huSP34.34.11 Fab-HF | 10.8 | 1.43E+05 | 1.18E−03 |

*Results represent the average of two independent runs

Selected huSP34 Fabs were next reformatted into bispecific antibodies (Example 2) and their CD3 affinities assessed by Octet are shown in Table 28.

TABLE 28

Anti-CD3 Affinity of Selected Bispecific Antibodies*

| Ab | Features | $K_D$(nM) | $k_{on}$(M$^{-1}$ s$^{-1}$) | $k_{off}$(s$^{-1}$) |
|---|---|---|---|---|
| 257 | hPGT121.66 AAS + W/huSP34.34.3 scFv AAS + SAV + R | 10.3 | 6.20E+05 | 6.19E−03 |
| 274 | hPGT121.66 AAS + W/huSP34.34.11 scFv AAS + SAV + R | 16.0 | 1.16E+05 | 1.72E−03 |
| 273 | hPGT121.66 AAS + W/huSP34.34.10 scFv AAS + SAV + R | 8.4 | 1.20E+05 | 8.30E−04 |
| 275 | hPGT121.66 AAS + W/huSP34.34.12 scFv AAS + SAV + R | 9.9 | 4.33E+05 | 4.31E−03 |
| 256 | hPGT121.66 AAS + W/huSP34.3.8 scFv AAS + SAV + R | 7.1 | 6.66E+04 | 4.75E−04 |
| 243 | hPGT121.66 AAS + W/huSP34.3.13 scFv AAS + SAV + R | 16.8 | 1.06E+05 | 1.71E−03 |
| 261 | hPGT121.66 AAS + W/huSP34.13.8 scFv AAS + SAV + R | 20.8 | 4.85E+04 | 9.47E−04 |

*Results represent the average of two independent runs

In order to facilitate purification of bispecific antibodies, A series of huSP34 variants were designed that incorporated mutations designed to reduce or ablate Protein A binding to the huSP34 VH3 domain. The Protein A knockouts were generated in the background of the huSP34.13.8 variant. The CD3 affinities (Octet) of bispecific antibodies incorporating these huSP34 Protein A knockout variants as well as the huSP34.13.8 variant are shown in Table 29. The results suggest that the Protein A knockout mutations had minimal impact on CD3 binding affinity.

TABLE 29

Protein A Knockouts in Bispecific Format Octet Data*

| Ab | Features | $K_D$(nM) | $k_{on}$(M$^{-1}$ s$^{-1}$) | $k_{off}$(s$^{-1}$) |
|---|---|---|---|---|
| 266 | hPGT121.66 AAS + W/huSP34.14.8scFv AAS + SAV + R | 24.3 | 3.90E+04 | 9.32E−04 |
| 267 | hPGT121.66 AAS + W/huSP34.19.8scFv AAS + SAV + R | 14.7 | 7.22E+04 | 1.04E−03 |
| 268 | hPGT121.66 AAS + W/huSP34.25.8scFv AAS + SAV + R | 10.6 | 8.76E+04 | 9.28E−04 |
| 269 | hPGT121.66 AAS + W/huSP34.26.8scFv AAS + SAV + R | 9.3 | 5.59E+04 | 5.04E−04 |
| 270 | hPGT121.66 AAS + W/huSP34.27.8 scFv AAS + SAV + R | 13.2 | 7.63E+04 | 1.00E−03 |
| 271 | hPGT121.66 AAS + W/huSP34.28.8 scFv AAS + SAV + R | 15.8 | 8.46E+04 | 1.34E−03 |
| 272 | hPGT121.66 AAS + W/huSP34.33.8 scFv AAS + SAV + R | 15.3 | 7.74E+04 | 1.18E−03 |

*Results represent the average of two independent runs

Example 6

CD3 Affinity Screening Using Surface Plasmon Resonance

Figure 10:
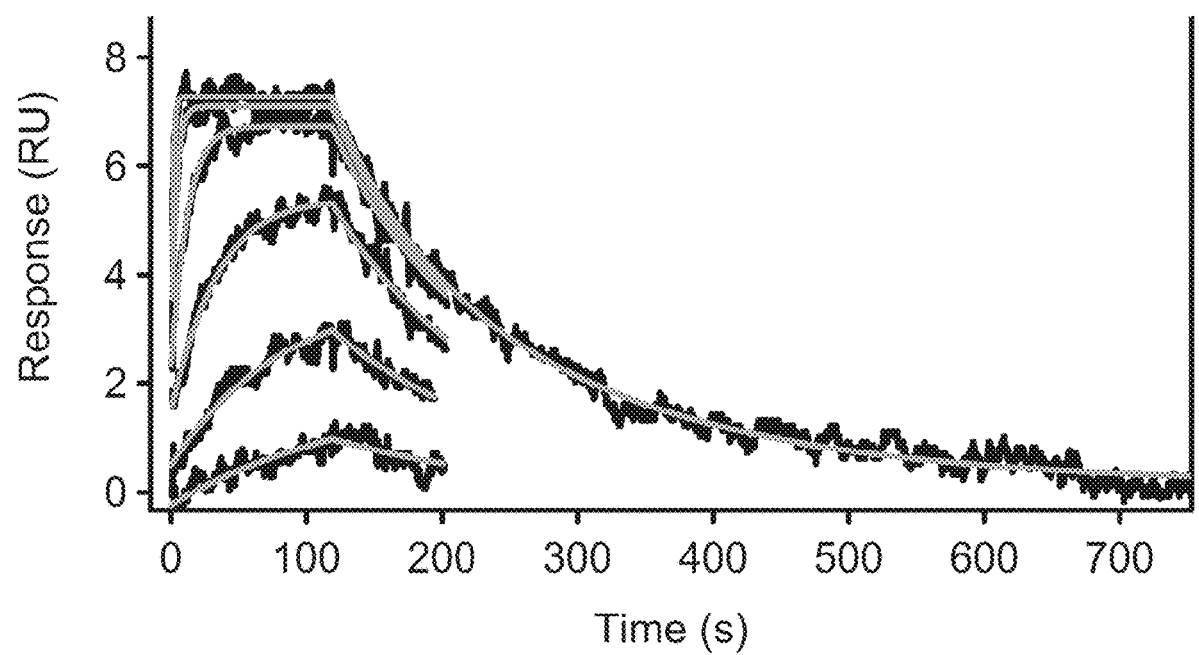
FIG. 10 illustrates representative binding of a bispecific to immobilized CD3 obtained from SPR experiments. Black lines denote injection of the bispecific 249 at various concentrations for a period of 120 seconds. Dissociation was then monitored for 80 seconds except for the highest concentration where dissociation was monitored for 10.5 minutes. Smoothed gray lines represent the fit to this data as obtained from a simple kinetic model. This model was used to derive $k_{on}$, $k_{off}$ and $K_D$ for these interactions.

To determine the CD3 binding kinetics of selected Fabs or bispecific antibodies, we next conducted surface plasmon resonance biosensor studies. Experiments were performed on a Biacore 4000 instrument. Streptavidin was chemically immobilized on a C1 chip. Biotinylated CD3 (Acro Biosystems, biotinylated Human CD3E and CD3D Cat CDD-H82W1, lot BVG51-93TF1-NY) was captured at various densities. Various bispecific fusions proteins containing huSP34 anti-CD3 scFv or Fab domains were then injected at various concentrations over the CD3 surfaces. Kinetic data was then fit to a simple kinetic model yielding rate constants $k_{on}$ and $k_{off}$ for the association and dissociation phases, and the equilibrium dissociation constant, $K_D$. FIG. 10 shows an example of data obtained from this study. Shown is the response obtained from the interaction of hPGT121.66 AAS W/huSP34.39.13 scFv AAS+SAV+R, injected at various concentrations all for a contact time of 120 seconds over CD3 surfaces, and then monitored for various dissociation times. Data was fit to a simple kinetic model. In this example, black lines denote data, and grey lines, the fit to the data. Values for Icon, $k_{off}$ and $K_D$ have been tabulated in Table 30.

TABLE 30

CD3 Binding Kinetic Parameters of Selected Bispecific Antibodies

| Ab | Features | $K_D$(nM) | $k_{on}$(M$^{-1}$ s$^{-1}$) | $k_{off}$(s$^{-1}$) |
|---|---|---|---|---|
| 243 | hPGT121.66 AAS + W/huSP34.3.13 scFv AAS + SAV + R | 2.4 | 3.60E+06 | 8.40E−03 |
| 257 | hPGT121.66 AAS + W/huSP34.34.3 scFv AAS + SAV + R | 43 | 3.90E+05 | 1.70E−02 |
| 274 | hPGT121.66 AAS + W/huSP34.34.11 scFv AAS + SAV + R | 3.9 | 3.30E+06 | 1.29E−02 |
| 273 | hPGT121.66 AAS + W/huSP34.34.10 scFv AAS + SAV + R | 3.9 | 2.60E+06 | 1.02E−02 |
| 275 | hPGT121.66 AAS + W/huSP34.34.12 scFv AAS + SAV + R | 32 | 3.70E+05 | 1.19E−02 |
| 256 | hPGT121.66 AAS + W/huSP34.3.8 scFv AAS + SAV + R | 2.5 | 2.80E+06 | 7.10E−03 |
| 249 | hPGT121.66 AAS W/huSP34.39.13 scFv AAS + SAV + R | 2.6 | 3.40E+06 | 9.00E−03 |
| 276 | hPGT121.66 AAS + W/huSP34.40.13 scFv AAS + SAV + R | 1.8 | 3.60E+06 | 6.30E−03 |
| 277 | hPGT121.66 AAS + W/huSP34.41.13 scFv AAS + SAV + R | 2.8 | 3.00E+06 | 8.50E−03 |
| 218 | h3BNC117.52.64 AAS + SAV + YTE/huSP34.3.13 scFv AAS + W + YTE | 2.7 | 3.30E+06 | 8.70E−03 |
| 180 | hCD4D1.22 Fc AAS + W + YTE/huSP34.39.13 AAS + SAV + R | 2.5 | 2.00E+06 | 4.90E−03 |
| 188 | hCD4D1.22 Fc AAS + W + YTE/huSP34.40.13 AAS + SAV + R | 1.6 | 2.20E+06 | 3.60E−03 |
| 189 | hCD4D1.22 Fc AAS + W + YTE/huSP34.41.13 AAS + SAV + R | 2.0 | 2.40E+06 | 4.70E−03 |

Example 7

Polyspecificity Assessment of huSP34 Variant Antibodies

Polyspecificity of therapeutic antibodies may adversely affect PK properties and present potential safety concerns. In this example, we evaluated the polyspecificity risk of antibodies in an anti-baculoviral particle (BVP) ELISA assay (Hötzel, et al., *mAbs* (2012) 4:753-760). Test articles were assayed at 75 µg/mL concentration in duplicate in each experiment, and the BVP score was calculated as a ratio of OD450 to no mAb background. The risk for polyspecificity of bivalent IgG was then determined by comparison of the BVP score to thresholds set by four benchmark antibodies for no, low, medium and high risk of polyspecificity (Jain, et al., *Proc. Natl. Acad. Sci. USA* (2017) 114:944-949).

To compare the polyspecificity of huSP34 variants with different anti-CD3 affinities, a panel of 28 IgG1s was tested in the BVP assay. The results of the BVP assays, including calculated BVP score and polyspecificity risk categorized based on thresholds determined by benchmark controls, are shown in Table 31. Significant differences in polyspecificity risk were observed among variants tested.

TABLE 31

Polyspecificity Assessment of SP34 IgG1 Variants in BVP assay.

| Name | BVP Score (mean) | BVP Score (stdv) | N |
|---|---|---|---|
| huSP34.2.1/hG1/hLam | 2.9 | 0.4 | 3 |
| huSP34.3.8/hG1/hLam | 3.1 | 0.6 | 3 |
| huSP34.1.1/hG1/hLam | 3.3 | 0.7 | 3 |
| huSP34.1.6/hG1/hLam | 4.5 | 0.7 | 3 |
| huSP34.11.7/hG1/hLam | 4.7 | 1.0 | 3 |
| huSP34.1.3/hG1/hLam | 5.3 | 1.8 | 8 |
| huSP34.12.10/hG1/hLam | 5.8 | 1.2 | 3 |
| huSP34.3.9/hG1/hLam | 7.5 | 0.8 | 3 |
| huSP34.13.10/hG1/hLam | 7.5 | 2.1 | 8 |
| huSP34.2.3/hG1/hLam | 7.5 | 11.5 | 3 |
| huSP34.2.6/hG1/hLam | 7.2 | 0.7 | 3 |
| huSP34.11.10/hG1/hLam | 7.2 | 2.0 | 3 |
| huSP34.3.1/hG1/hLam | 8.1 | 2.1 | 3 |
| huSP34.4.1/hG1/hLam | 8.5 | 1.3 | 3 |
| huSP34.3.10/hG1/hLam | 9.0 | 1.0 | 3 |
| huSP34.12.8/hG1/hLam | 9.2 | 0.8 | 3 |
| huSP34.3.6/hG1/hLam | 9.2 | 3.5 | 8 |
| huSP34.3.3/hG1/hLam | 10.2 | 2.0 | 3 |
| huSP34.4.3/hG1/hLam | 11.4 | 3.1 | 3 |
| huSP34.3.7/hG1/hLam | 12.1 | 3.0 | 3 |
| huSP34.12.9/hG1/hLam | 13.2 | 1.6 | 3 |
| huSP34.4.6/hG1/hLam | 13.8 | 3.0 | 3 |
| huSP34.11.8/hG1/hLam | 13.4 | 2.9 | 3 |
| huSP34.13.8/hG1/hLam | 14.3 | 4.0 | 8 |
| huSP34.12.7/hG1/hLam | 15.5 | 3.8 | 3 |
| huSP34.13.9/hG1/hLam | 18.0 | 5.6 | 3 |
| huSP34.11.9/hG1/hLam | 18.1 | 4.8 | 3 |
| huSP34.13.7/hG1/hLam | 18.2 | 4.5 | 3 |

In order to further evaluate polyspecificity risk of selected anti-CD3 SP34 variants in various bispecific antibody formats, selected huSP34 heavy chain and light chain variant pairs were selected to produce anti-HIV gp120 bispecific antibodies and tested alongside a number of related human IgG1 and effector enhanced human IgG1 antibodies. The results of this BVP analysis are shown in Table 32. The results suggest that the PGT121.66 anti-gp120 binding arm used for these studies has a low BVP score when formatted as an effector functional enhanced human IgG1. The results also suggest that huSP34 variants with low BVP scores as an IgG1, also have low BVP scores when formatted as bispecific antibodies. Finally, the results suggest that the H435R+ Y436F Fc mutation introduced to eliminate Protein A binding in the "hole" Fc domain has no impact on polyspecificity.

TABLE 32

Polyspecificity Assessment of huSP34 and PGT121 Variants Formatted as IgG1, Effector Enhanced IgG1 or Bispecific Antibodies

| Ab | Features | Avg. BVP | stdev | N |
|---|---|---|---|---|
|  | huSP34.13.8/hG1/hLam | 14.2 | 4.1 | 8 |
|  | huSP34.13.10/hG1/hLam | 7.1 | 2.0 | 8 |
|  | huSP34.1.3/hG1/hLam | 5.3 | 1.6 | 8 |
|  | huSP34.3.6/hG1/hLam | 9.2 | 2.9 | 8 |
| 250 | hPGT121.66 AAS + SAV/huSP34.1.3 scFv AAS + W | 5.5 | 1.1 | 5 |
| 251 | hPGT121.66 AAS + W/huSP34.1.3 scFv AAS + SAV + RF | 5.4 | 2.1 | 5 |
| 265 | hPGT121.66 AAS + W/huSP34.13.10 scFv AAS + SAV + RF | 12.6 | 4.4 | 5 |
| 258 | hPGT121.66 AAS + W/huSP34.3.4 scFv AAS + SAV + RF | 9.3 | 3.3 | 5 |
| 260 | hPGT121.66 AAS + W/huSP34.8.3 scFv AAS + SAV + RF | 4.8 | 1.6 | 5 |
|  | PGT121.66 hIgG1/hLambda | 4.0 | 1.2 | 5 |

In order to assess the role of both anti-CD3 affinity and anti-CD3 Protein A knockout mutations (see, Example 3) made in the variable domain of huSP34, we produced a panel of HIV anti-gp120 bispecific antibodies with different anti-CD3 huSP34 variant arms, but containing the same PGT121.66 targeting arm and identical knob-in-hole bispecific Fc domains incorporating the H435R Fc Protein A knockout mutation. The results of the BVP analysis conducted on these antibodies is shown in Table 33. The results suggest that the Protein A knockout variants show only small increases in polyspecificity compared to huSP34.13.8 and further identify the huSP34.3.13 variant as the molecule with the lowest polyspecificity.

TABLE 33

Polyspecificity assessment of huSP34 scFv Affinity Variants and huSP34 scFv Protein A Knockout Variants Formatted as Anti-HIV gp120 Bispecific Antibodies

| Ab | Features | Avg. BVP | stdev | N |
|---|---|---|---|---|
| 261 | hPGT121.66 AAS + W/huSP34.13.8scFv AAS + SAV + R | 15.1 | 1.7 | 3 |
| 266 | hPGT121.66 AAS + W/huSP34.14.8scFv AAS + SAV + R | 15.7 | 3.7 | 3 |
| 267 | hPGT121.66 AAS + W/huSP34.19.8scFv AAS + SAV + R | 18.2 | 2.2 | 3 |
| 268 | hPGT121.66 AAS + W/huSP34.25.8scFv AAS + SAV + R | 20.0 | 2.1 | 3 |
| 269 | hPGT121.66 AAS + W/huSP34.26.8scFv AAS + SAV + R | 20.8 | 2.1 | 3 |
| 270 | hPGT121.66 AAS + W/huSP34.27.8scFv AAS + SAV + R | 22.0 | 1.2 | 3 |
| 271 | hPGT121.66 AAS + W/huSP34.28.8scFv AAS + SAV + R | 21.7 | 1.4 | 3 |
| 272 | hPGT121.66 AAS + W/huSP34.33.8scFv AAS + SAV + R | 21.2 | 2.0 | 3 |
| 257 | hPGT121.66 AAS + W/huSP34.34.3scFv AAS + SAV + R | 11.6 | 3.1 | 3 |
| 274 | hPGT121.66 AAS + W/huSP34.34.11scFv AAS + SAV + R | 14.8 | 3.6 | 3 |
| 273 | hPGT121.66 AAS + W/huSP34.34.10scFv AAS + SAV + R | 18.5 | 4.2 | 7 |
| 275 | hPGT121.66 AAS + W/huSP34.34.12scFv AAS + SAV + R | 15.3 | 3.6 | 3 |
| 256 | hPGT121.66 AAS + W/huSP34.3.8scFv AAS + SAV + R | 13.9 | 2.8 | 5 |
| 243 | hPGT121.66 AAS + W/huSP34.3.13scFv AAS + SAV + R | 8.6 | 2.5 | 7 |

We next conducted BVP assays on a panel of anti-HIV-gp120 bispecific antibodies containing the three most effective Protein A knockout variants in the huSP34.3.13 scFv background alongside relevant controls. The results of this assessment are shown in Table 34 and demonstrate that huSP34 Protein A knockout variants huSP34.39.13 has a very similar polyspecificity risk as huSP34.3.13. In contrast, huSP34.40.13 and huSP34.41.13 exhibit high BVP scores more like huSP34.34.10.

TABLE 34

Polyspecificity Assessment of huSP34 scFv Protein A Knockout Variants and Controls Formatted as Anti-HIV gp120 Bispecific Antibodies

| Ab | Features | Avg. BVP | stdev | N |
|---|---|---|---|---|
| 243 | hPGT121.66 AAS + W/huSP34.3.13scFv AAS + SAV + R | 8.6 | 2.5 | 7 |
| 273 | hPGT121.66 AAS + W/huSP34.34.10scFv AAS + SAV + R | 18.5 | 4.2 | 7 |
| 249 | hPGT121.66 AAS W/huSP34.39.13scFv AAS SAV R | 9.3 | 1.7 | 4 |
| 276 | hPGT121.66 AAS + W/huSP34.40.13scFv AAS + SAV + R | 14.2 | 3.0 | 4 |
| 277 | hPGT121.66 AAS + W/huSP34.41.13scFv AAS + SAV + R | 13.6 | 3.0 | 4 |

Example 8

T-cell Binding Characterization of huSP34 Variant Fabs and Anti-HIV gp120 Bispecific Antibodies by Flow Cytometry Binding of humanized SP34 Fab variants to CD3 expressed on cell-surface of primary human T cells was evaluated in a flow cytometry-based competition assay. Different concentrations of huSP34 Fab variants as well as mSP34, were incubated with $1 \times 10^5$ T-cells in RPMI containing 0.2 µL of murine SP34-Alexa Fluor 488 (BD Pharmingen Cat #557705), 0.5 µL anti-CD4-BV711 mAb (BD Biosciences Cat #563028) and 0.5 µL anti-CD8-APC/Cy7 mAb (BD Biosciences Cat #560179) for 1 hour at room temperature. Cells were then washed, fixed, and murine SP34-AF488 binding to cell-surface CD3 was measured on a flow cytometer (BD LSRFortessa). The concentration of each huSP34 Fab variant or control that resulted in 50% inhibition (IC50) of murine SP34-AF488 binding to cell-surface CD3 was calculated using GraphPad Prism.

Round 1 huSP34 Variants

As summarized in Table 35, all of the first round huSP34 Fab variants tested exhibited mean IC50 values that ranged from 1.3 µg/mL to greater than 20 µg/mL and were higher (i.e., less potent binding) than that of mSP34 (0.70 µg/mL).

TABLE 35

IC50 values of first round SP34 humanization Fab variants

| huSP34 Fab | FACs IC50 (µg/ml) n = 1 | FACs IC50 (µg/ml) n = 2 | Average (µg/ml) |
|---|---|---|---|
| huSP34.1.3 Fab-HF | 1.53 | 1.13 | 1.33 |
| huSP34.1.6 Fab-HF | 1.67 | 1.12 | 1.39 |
| huSP34.1.1 Fab-HF | 1.72 | 1.27 | 1.49 |
| huSP34.3.3 Fab-HF | 2.95 | 1.99 | 2.47 |
| huSP34.3.1 Fab-HF | 3.56 | 2.22 | 2.89 |
| huSP34.3.6 Fab-HF | 8.48 | 1.03 | 4.75 |
| huSP34.2.3 Fab-HF | 4.24 | 3.15 | 3.70 |
| huSP34.2.6 Fab-HF | 4.68 | 3.40 | 4.04 |
| huSP34.2.1 Fab-HF | 6.17 | 3.68 | 4.92 |
| huSP34.4.3 Fab-HF | 7.94 | 5.11 | 6.53 |
| huSP34.1.2 Fab-HF | 8.21 | 5.29 | 6.75 |
| huSP34.4.1 Fab-HF | 9.57 | 5.90 | 7.74 |
| huSP34.3.2 Fab-HF | 11.93 | 6.44 | 9.19 |
| huSP34.4.6 Fab-HF | 18.52 | 4.20 | 11.36 |
| huSP34.3.5 Fab-HF | 12.88 | 10.00 | 11.44 |
| huSP34.1.4 Fab-HF | 15.03 | 11.80 | 13.41 |
| huSP34.1.5 Fab-HF | 17.34 | 12.46 | 14.90 |
| huSP34.2.2 Fab-HF | >20 | 16.59 | 16.59 |
| huSP34.3.4 Fab-HF | >20 | 17.34 | 17.34 |
| huSP34.5.1 Fab-HF | >20 | >20 | >20 |
| huSP34.4.2 Fab-HF | >20 | >20 | >20 |
| huSP34.5.2 Fab-HF | >20 | >20 | >20 |
| huSP34.5.3 Fab-HF | >20 | >20 | >20 |
| huSP34.2.4 Fab-HF | >20 | >20 | >20 |
| huSP34.4.4 Fab-HF | >20 | >20 | >20 |

TABLE 35-continued

IC50 values of first round SP34 humanization Fab variants

| huSP34 Fab | FACs IC50 (μg/ml) n = 1 | FACs IC50 (μg/ml) n = 2 | Average (μg/ml) |
|---|---|---|---|
| huSP34.5.4 Fab-HF | >20 | >20 | >20 |
| huSP34.2.5 Fab-HF | >20 | >20 | >20 |
| huSP34.4.5 Fab-HF | >20 | >20 | >20 |
| huSP34.5.5 Fab-HF | >20 | >20 | >20 |
| huSP34.5.6 Fab-HF | >20 | >20 | >20 |
| huSP34.6.1 Fab-HF | >20 | | >20 |
| huSP34.6.2 Fab-HF | >20 | | >20 |
| huSP34.6.3 Fab-HF | >20 | | >20 |
| huSP34.6.4 Fab-HF | >20 | | >20 |
| huSP34.6.5 Fab-HF | >20 | | >20 |
| huSP34.6.6 Fab-HF | >20 | | >20 |
| huSP34.7.1 Fab-HF | >20 | | >20 |
| huSP34.7.3 Fab-HF | >20 | | >20 |
| huSP34.7.6 Fab-HF | >20 | | >20 |
| huSP34.8.1 Fab-HF | >20 | | >20 |
| huSP34.8.2 Fab-HF | >20 | | >20 |
| huSP34.8.3 Fab-HF | >20 | | >20 |
| huSP34.8.4 Fab-HF | >20 | | >20 |
| huSP34.8.5 Fab-HF | >20 | | >20 |
| huSP34.8.6 Fab-HF | >20 | | >20 |
| huSP34.9.1 Fab-HF | >20 | | >20 |
| huSP34.9.2 Fab-HF | >20 | | >20 |
| huSP34.9.3 Fab-HF | >20 | | >20 |
| huSP34.9.4 Fab-HF | >20 | | >20 |
| huSP34.9.5 Fab-HF | >20 | | >20 |
| huSP34.9.6 Fab-HF | >20 | | >20 |
| huSP34.10.1 Fab-HF | >20 | | >20 |
| huSP34.10.2 Fab-HF | >20 | | >20 |
| huSP34.10.3 Fab-HF | >20 | | >20 |
| huSP34.10.4 Fab-HF | >20 | | >20 |
| huSP34.10.5 Fab-HF | >20 | | >20 |
| huSP34.10.6 Fab-HF | >20 | | >20 |
| mSP34 Fab HF | | | 0.70 |

Round 2 huSP34 Variants

A second round of huSP34 Fab variants were characterized using the same flow cytometry-based competition assay as described above. As summarized in Table 36, all variants from this round exhibited geometric mean IC50 values that ranged from 0.15-0.73 μg/mL, many of which were improved relative to mSP34 (IC50 0.68 μg/mL).

TABLE 36

IC50 Values of Second Round SP34 Humanization Fab Variants

| huSP34 Fab | FACs IC50 (μg/ml) n = 1 | FACs IC50 (μg/ml) n = 2 | Average (μg/ml) |
|---|---|---|---|
| huSP34.3.10 Fab-HF | 0.20 | 0.09 | 0.15 |
| huSP34.3.8 Fab-HF | 0.20 | 0.10 | 0.15 |

TABLE 36-continued

IC50 Values of Second Round SP34 Humanization Fab Variants

| huSP34 Fab | FACs IC50 (μg/ml) n = 1 | FACs IC50 (μg/ml) n = 2 | Average (μg/ml) |
|---|---|---|---|
| huSP34.11.8 Fab-HF | 0.30 | 0.13 | 0.22 |
| huSP34.3.7 Fab-HF | 0.30 | 0.15 | 0.23 |
| huSP34.13.8 Fab-HF | 0.36 | 0.14 | 0.25 |
| huSP34.11.10 Fab-HF | 0.35 | 0.15 | 0.25 |
| huSP34.13.10 Fab-HF | 0.35 | 0.16 | 0.25 |
| huSP34.3.9 Fab-HF | 0.39 | 0.17 | 0.28 |
| huSP34.13.7 Fab-HF | 0.43 | 0.18 | 0.31 |
| huSP34.11.7 Fab-HF | 0.45 | 0.18 | 0.32 |
| huSP34.13.9 Fab-HF | 0.48 | 0.25 | 0.36 |
| huSP34.11.9 Fab-HF | 0.57 | 0.22 | 0.40 |
| huSP34.12.8 Fab-HF | 0.57 | 0.29 | 0.43 |
| huSP34.12.10 Fab-HF | 0.69 | 0.33 | 0.51 |
| huSP34.12.7 Fab-HF | 0.77 | 0.39 | 0.58 |
| huSP34.12.9 Fab-HF | 0.97 | 0.49 | 0.73 |
| mSP34 Fab HF | | | 0.68 |

Example 9

Characterization of HIV×CD3 Bispecific Molecules in T Cell Binding Assay

We characterized the T cell binding activity of a panel of five HIV×CD3 bispecific molecules that harbor a common α-HIV envelope binding arm, PGT121.66 paired with huSP34 variants (in scFv format) selected to cover a range of CD3-binding affinities as previously determined by bio-layer interferometry (BLI) and flow cytometry-based competition assays. Briefly, peripheral blood mononuclear cells (PBMCs) were incubated with different concentrations of HIV×CD3 bispecific molecules for 1 hour at RT. Cells were then washed and stained with α-huIgG-APC (Jackson ImmunoResearch Cat #109-136-098), α-CD4-BV711 (BD Biosciences Cat #563028), and α-CD8-APC-Cy7 (BD Biosciences Cat #560179) for 20 minutes at RT. Cells were then washed, fixed/permeabilized, and analyzed using BD LSR-Fortessa according to the manufacturer's protocol. The percentage of α-huIgG-APC-positive CD4+ and CD8+ T cells and the mean fluorescence intensity of the α-huIgG-APC of CD4+ and CD8+ cells were collected, and data analyzed using GraphPad Prism.

Figure 11:
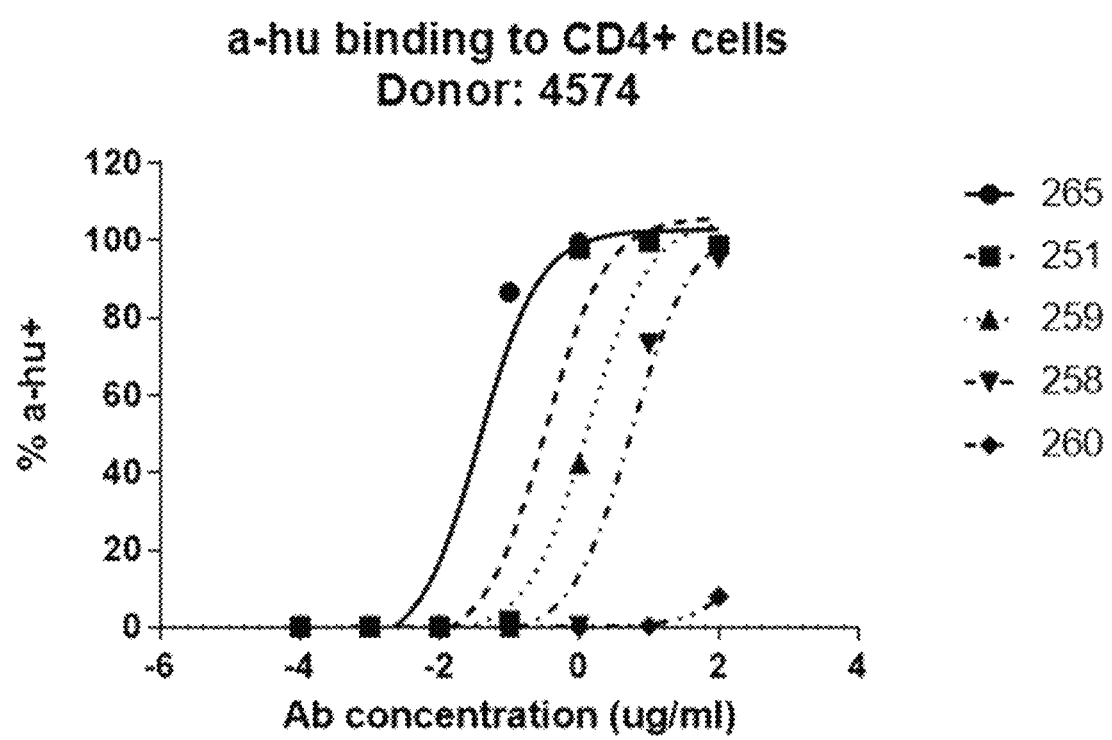
FIG. 11 illustrates a representative binding concentration-response curve of PGT121.66×huSP34 bispecific antibodies 265 (circle), 251 (square), 259 (upright triangle; dotted line). 258 (inverted triangle; solid line) and 260 (diamond) to CD4+ T cells (from Donor 4574). Bispecific molecules described herein are summarized in Table 53.
Figure 12:
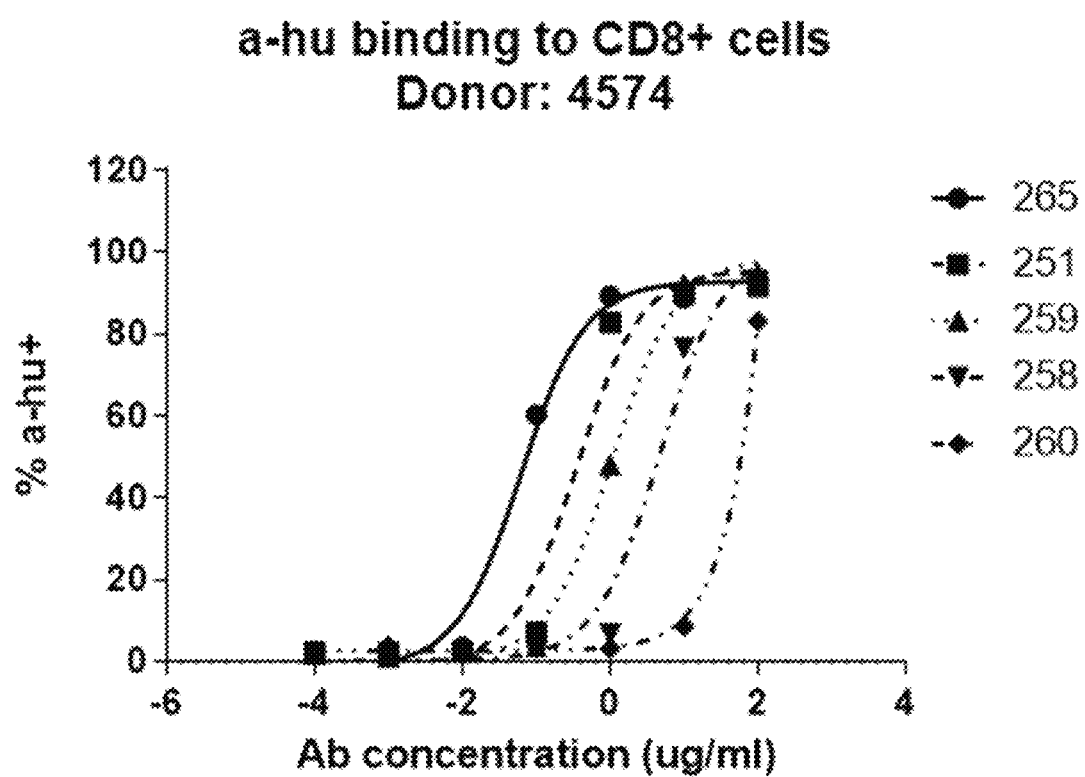
FIG. 12 illustrates a representative binding concentration-response curve of PGT121.66×huSP34 bispecific antibodies 265 (circle), 251 (square), 259 (upright triangle; dotted line). 258 (inverted triangle; solid line) and 260 (diamond) to CD8+ T cells (from Donor 4574).
Figures 13A, 13B:
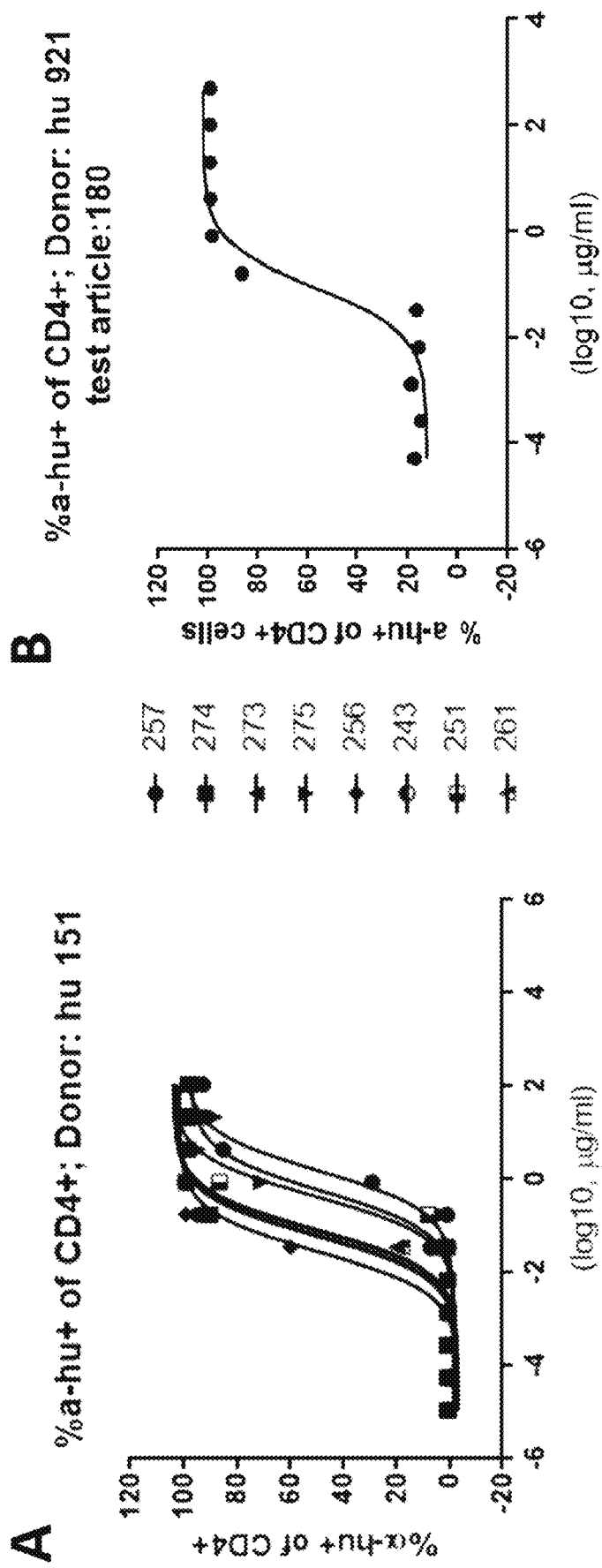
FIGS. 13A-13B illustrate a representative binding concentration-response curve of (A) PGT121.66×huSP34 bispecific antibodies 257 (solid circle), 274 (solid square), 273 (solid, upright triangle), 275 (solid inverted triangle), 256 (solid diamond), 243 (half-solid circle), 251 (half-solid square) and 261 (half-solid upright triangle) to human CD4+ T cells in PBMCs (from Donor hu 151) and (B) CD4× huSP34 bispecific 180 to human CD4+ T cells in PBMCs (from Donor hu 921).
Figure 14A:
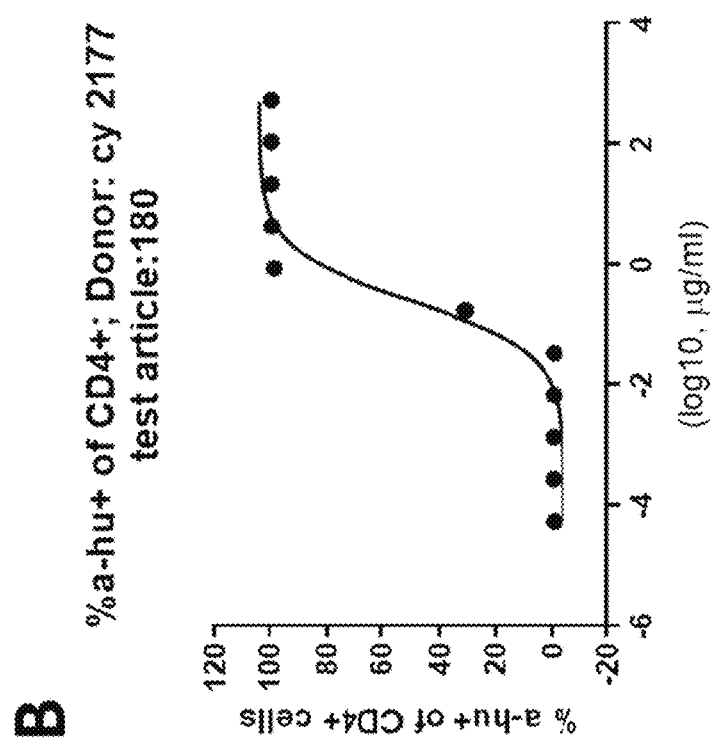
FIGS. 14A-14B illustrate a representative binding concentration-response curve of (A) PGT121.66×huSP34 bispecific antibodies 257 (solid circle), 274 (solid square), 273 (solid, upright triangle), 275 (solid inverted triangle), 256 (solid diamond), 243 (half-solid circle), 251 (half-solid square) and 261 (half-solid upright triangle) to monkey CD4+ T cells in PBMCs (from rhesus Donor rh 3563) and (B) CD4×huSP34 bispecific 180 to monkey CD4+ T cells in PBMCs (from cynomolgus Donor cy 2177).
Figure 14B:
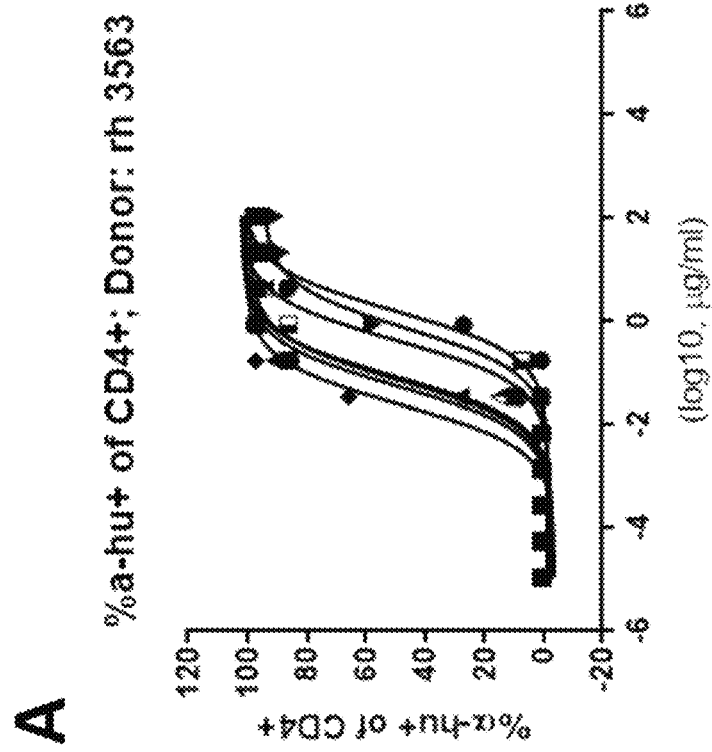
Figure 15A:
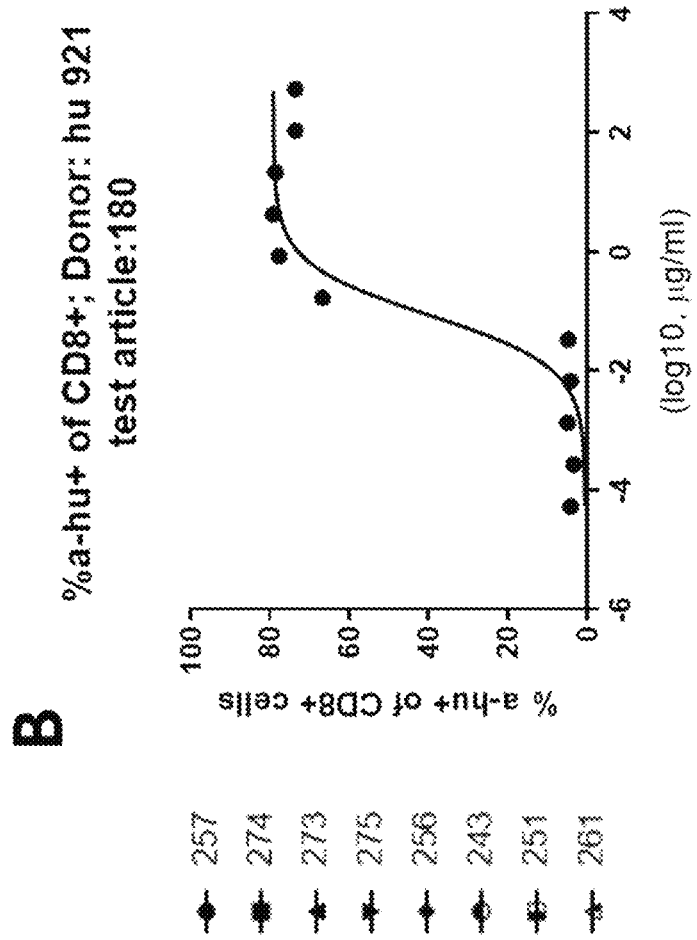
FIGS. 15A-15B illustrate a representative binding concentration-response curve of (A) PGT121.66×huSP34 bispecific antibodies 257 (solid circle), 274 (solid square), 273 (solid, upright triangle), 275 (solid inverted triangle), 256 (solid diamond), 243 (half-solid circle), 251 (half-solid square) and 261 (half-solid upright triangle) to human CD8+ T cells in PBMCs (from Donor hu 151) and (B) CD4× huSP34 bispecific 180 to human CD8+ T cells in PBMCs (from Donor hu 921).
Figure 15B:
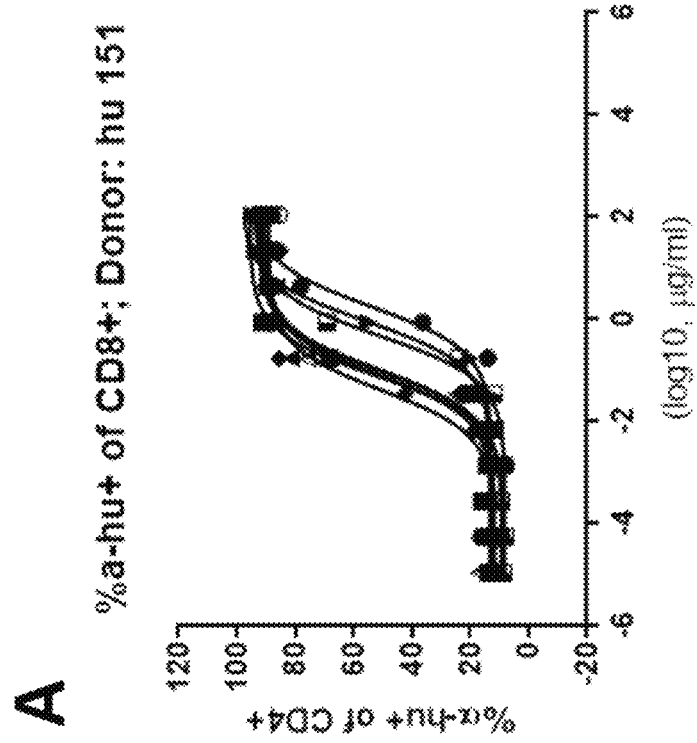
Figures 16A, 16B:
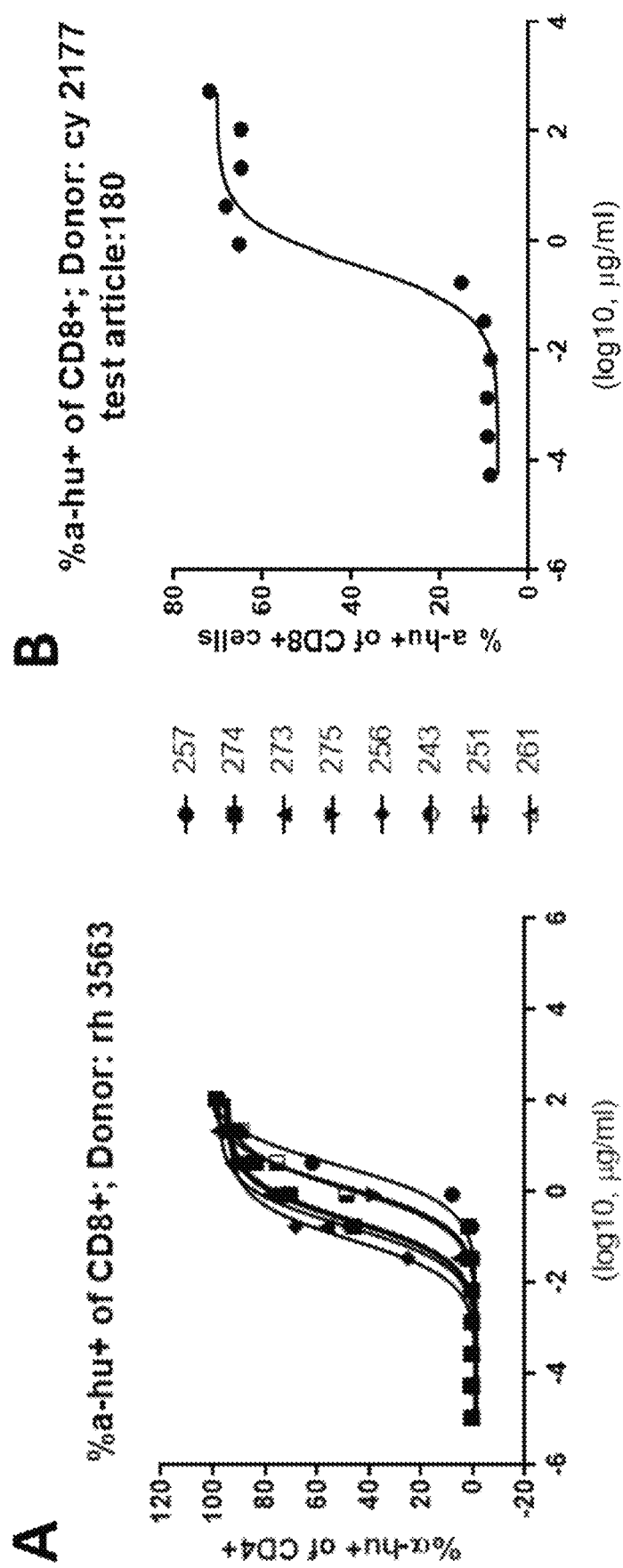
FIGS. 16A-16B illustrates a representative binding concentration-response curve of (A) PGT121.66×huSP34 bispecific antibodies 257 (solid circle), 274 (solid square), 273 (solid, upright triangle), 275 (solid inverted triangle), 256 (solid diamond), 243 (half-solid circle), 251 (half-solid square) and 261 (half-solid upright triangle) to rhesus CD8+ PBMCs (from Donor rh 3563) and (B) CD4×huSP34 bispecific 180 to monkey CD8+ T cells in PBMCs (from cynomolgus Donor cy 2177).
Figure 17:
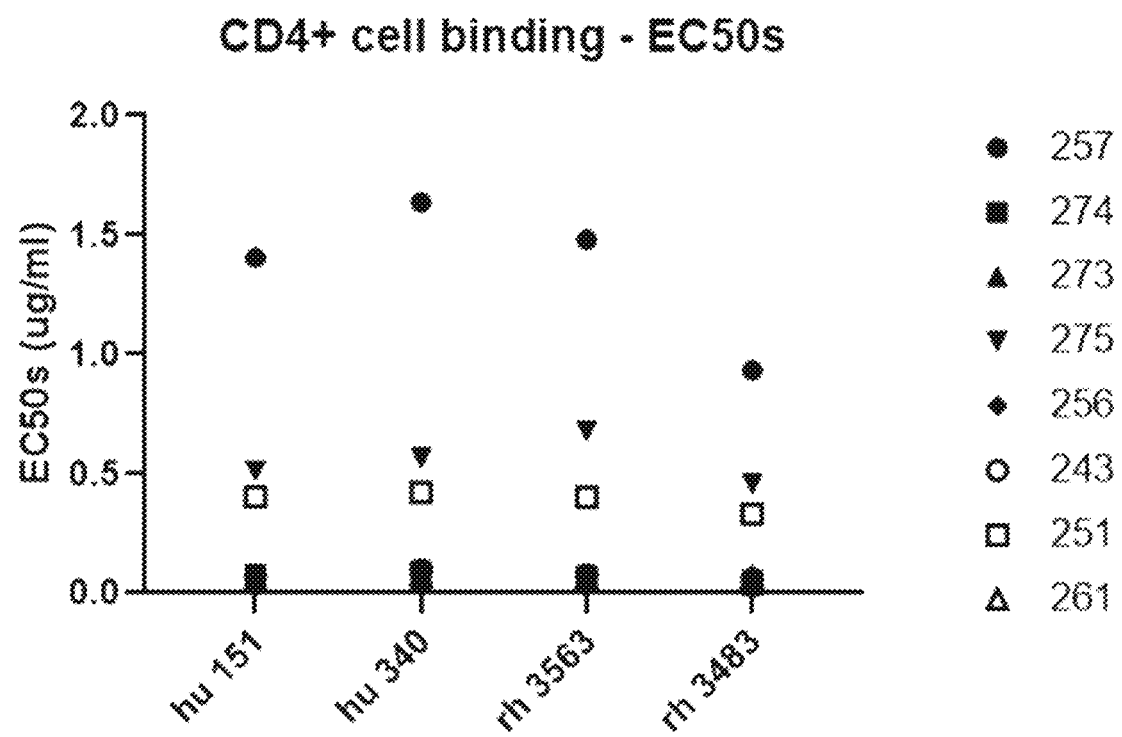
FIG. 17 illustrates $EC_{50}$ values derived from concentration-response curves of PGT121.66×huSP34 bispecific antibodies 257 (solid circle), 274 (solid square), 273 (solid, upright triangle), 275 (solid inverted triangle), 256 (solid diamond), 243 (open circle), 251 (open square) and 261 (open upright triangle) binding to human (hu) and rhesus (rh) CD4+ PBMCs.
Figure 18:
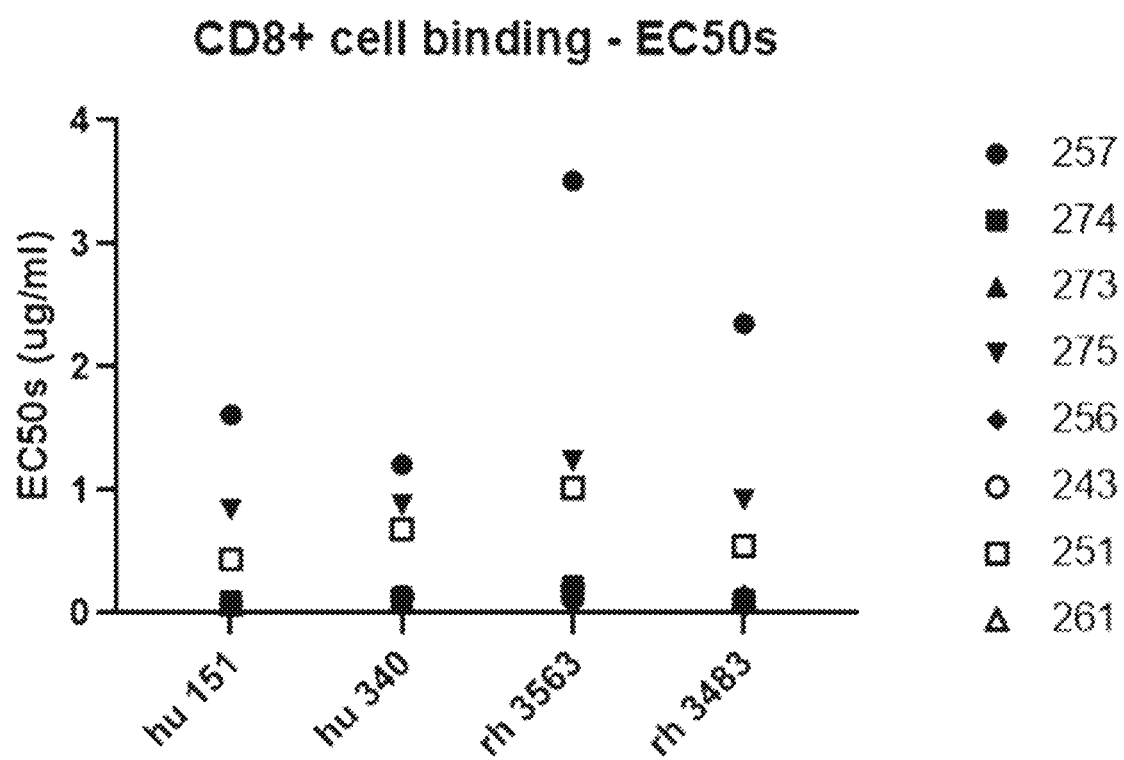
FIG. 18 illustrates $EC_{50}$ values derived from concentration-response curves of PGT121.66×huSP34 bispecific antibodies 257 (solid circle), 274 (solid square), 273 (solid, upright triangle), 275 (solid inverted triangle), 256 (solid diamond), 243 (open circle), 251 (open square) and 261 (open upright triangle) binding to human (hu) and rhesus (rh) CD8+ PBMCs.

Binding experiments were performed using PBMCs from two healthy human donors. Overall, the $EC_{50}$ ranking for this panel of HIV×CD3 bispecific molecules compared well with $K_D$ ranking previously determined by BLI for huSP34 variants in Fab format, and this was observed in both CD4+ and CD8+ T cell populations. The data is depicted in FIGS. 11 and 12, and summarized in Table 37.

TABLE 37

$EC_{50}$ Values Derived from Concentration-Response Curves of PGT121.66 × huSP34 Bispecifics Binding to PBMCs and Compared with KD Previously Determined by BLI for huSP34 Variants in Fab Format.

| | | | $EC_{50}$ (μg/mL) | | | |
|---|---|---|---|---|---|---|
| | | | Donor 3761 | | Donor 4574 | |
| Ab # | Features | huSP34 Fab $K_D$ (nM) | CD4+ cells | CD8+ cells | CD4+ cells | CD8+ cells |
| 265 | hPGT121.66 AAS + W/huSP34.13.10scFv AAS + SAV + RF | 1.8 | 0.045 | 0.095 | 0.037 | 0.062 |
| 251 | hPGT121.66 AAS + W/huSP34.1.3scFv AAS + SAV + RF | 13 | 0.32 | 0.36 | 0.33 | 0.35 |
| 259 | hPGT121.66 AAS + W/huSP34.3.6scFv AAS + SAV + RF | 19 | 0.65 | 0.48 | 1.4 | 1.1 |
| 258 | hPGT121.66 AAS + W/huSP34.3.4scFv AAS + SAV + RF | 86 | 5.1 | 1.3 | 5.7 | 4.8 |
| 260 | hPGT121.66 AAS + W/huSP34.8.3scFv AAS + SAV + RF | 284 | >100 | 31.190 | >100 | >100 |

To assess whether humanized SP34 variants cross react to non-human primate CD3 with similar affinity, we characterized the human and rhesus monkey T cell binding activity of a panel of eight HIV×CD3 bispecific molecules that harbor a common α-HIV envelope binding arm, PGT121.66, or CD4 D1.22 domain, paired with huSP34 variants (in scFv or Fab formats) covering a range of CD3-binding affinities as previously determined by BLI or flow cytometry-based competition assays. Briefly, PBMCs from healthy human donors and healthy rhesus or cynomolgus monkey donors were incubated with different concentrations of HIV×CD3 bispecific molecules for 1 hour at RT. Cells were then washed and stained with α-huIgG-APC (Jackson ImmunoResearch Cat #109-136-098), α-CD4-BV711 (BD Biosciences Cat #563028), and α-CD8-APC-Cy7 (BD Biosciences Cat #560179) for 20 minutes at RT. Cells were then washed, fixed/permeabilized, and analyzed on BD LSRFortessa. The percentage of α-huIgG-APC-positive CD4+ and CD8+ T cells and the mFI of the α-huIgG-APC of CD4+ and CD8+ cells were collected, and data analyzed using GraphPad Prism.

FIG. 13-18 depict representative binding concentration-response curves.

For all eight bispecific molecules tested in this panel, the $EC_{50}$ values determined for human and rhesus monkey T cell binding were within 2-fold of each other, suggesting huSP34 variant arm bound to human and monkey T cell with similar affinity. The data are summarized in Tables 38-39). This was observed in both CD4+ and CD8+ T cell populations.

TABLE 39

$EC_{50}$ Values of Binding Concentration-Response Curve of PGT121.66 × huSP34 and CD4 × huSP34 Bispecifics to Human and Monkey CD8+ PBMCs $EC_{50}$ (µg/mL) of % α-hu+ CD8+ cells

| | Bispecific Antibody Name | | | | | | | | |
|---|---|---|---|---|---|---|---|---|---|
| Donor | 257 | 274 | 273 | 275 | 256 | 243 | 251 | 261 | 180 |
| hu 151 | 1.62 | 0.10 | 0.07 | 0.85 | 0.04 | 0.09 | 0.44 | 0.08 | — |
| hu 340 | 1.21 | 0.13 | 0.08 | 0.88 | 0.06 | 0.14 | 0.68 | 0.10 | — |
| hu 711 | — | — | — | — | — | — | — | — | 1.10 |
| hu 921 | — | — | — | — | — | — | — | — | 0.08 |
| rh 3563 | 3.52 | 0.22 | 0.16 | 1.24 | 0.08 | 0.21 | 1.02 | 0.20 | — |
| rh 3483 | 2.35 | 0.11 | 0.10 | 0.93 | 0.04 | 0.11 | 0.55 | 0.13 | — |
| cy 2177 | — | — | — | — | — | — | — | — | 1.09 |

Example 10

In Vitro Killing of HIV-Infected CEM-NKr-CCr5-LucR+ CD4+ T Cells

The influence of CD3 affinity on CD3-bispecifics killing activity was assessed using HIV×CD3 bispecific molecules created using PGT121.66 as the Env-targeting arm and huSP34 (in scFv format) with a range of CD3 affinities as previously determined by BLI. The equilibrium dissociation constant (KD) of the CD3 Fabs used for creating the HIV×CD3 molecules are presented in Table 40.

TABLE 40

PGT121.66 × CD3 Bispecific Panel and CD3 Binding Affinity for Corresponding huSP34 Fab Variants

| Ab | Features | huSP34 Fab - $K_D$ (nM) |
|---|---|---|
| 265 | hPGT121.66 AAS + W/huSP34.13.10scFv AAS + SAV + RF | 1.8 |
| 251 | hPGT121.66 AAS + W/huSP34.1.3scFv AAS + SAV + RF | 13 |
| 259 | hPGT121.66 AAS + W/huSP34.3.6scFv AAS + SAV + RF | 19 |
| 258 | hPGT121.66 AAS + W/huSP34.3.4scFv AAS + SAV + RF | 86 |
| 260 | hPGT121.66 AAS + W/huSP34.8.3scFv AAS + SAV + RF | 284 |

TABLE 38

$EC_{50}$ Values of Binding Concentration-Response Curve of PGT121.66 × huSP34 and CD4 × huSP34 Bispecifics to Human and Monkey CD4+ PBMCs $EC_{50}$ (µg/mL) of % α-hu+ CD4+ PBMCs

| | Bispecific Antibody Name | | | | | | | | |
|---|---|---|---|---|---|---|---|---|---|
| Donor | 257 | 274 | 273 | 275 | 256 | 243 | 251 | 261 | 180 |
| hu 151 | 1.41 | 0.08 | 0.06 | 0.51 | 0.03 | 0.07 | 0.41 | 0.06 | — |
| hu 340 | 1.64 | 0.09 | 0.06 | 0.57 | 0.05 | 0.10 | 0.42 | 0.07 | — |
| hu 711 | — | — | — | — | — | — | — | — | 0.54 |
| hu 921 | — | — | — | — | — | — | — | — | 0.09 |
| rh 3563 | 1.48 | 0.07 | 0.05 | 0.68 | 0.02 | 0.08 | 0.40 | 0.07 | — |
| rh 3483 | 0.93 | 0.06 | 0.03 | 0.46 | 0.02 | 0.06 | 0.33 | 0.07 | — |
| cy 2177 | — | — | — | — | — | — | — | — | 0.50 |

The HIV-infected cell killing activity was evaluated using the CEM-NKr-CCR5-LucR+ lymphoblastoid reporter cell line infected with 5 different HIV-1 primary isolates or molecular clones as target cells and PBMCs or isolated T cells from two healthy donors as effector cells. CEM-NKr-CCR5-LucR+ cells were infected for 3 days, washed and co-cultured with PGT121.66×CD3 bispecific molecules and PBMCs (25:1 effector:target cell ratio) or isolated T cells (20:1 effector:target cell ratio) for 2 days and expression of tat-driven luciferase was quantified using One-Glo luciferase reagent (Promega). The percent infected cell killing was calculated using the following equation:

100−((RLU of HIV-infected target cells in treated wells/RLU HIV-infected target cells in untreated wells)*100).

For concentration-response curves that had an apparent $E_{max}$<20%, the $E_{max}$ values were reported as <20% and the $EC_{50}$ values reported as >100 µg/mL (maximum concentration tested).

Figure 19:
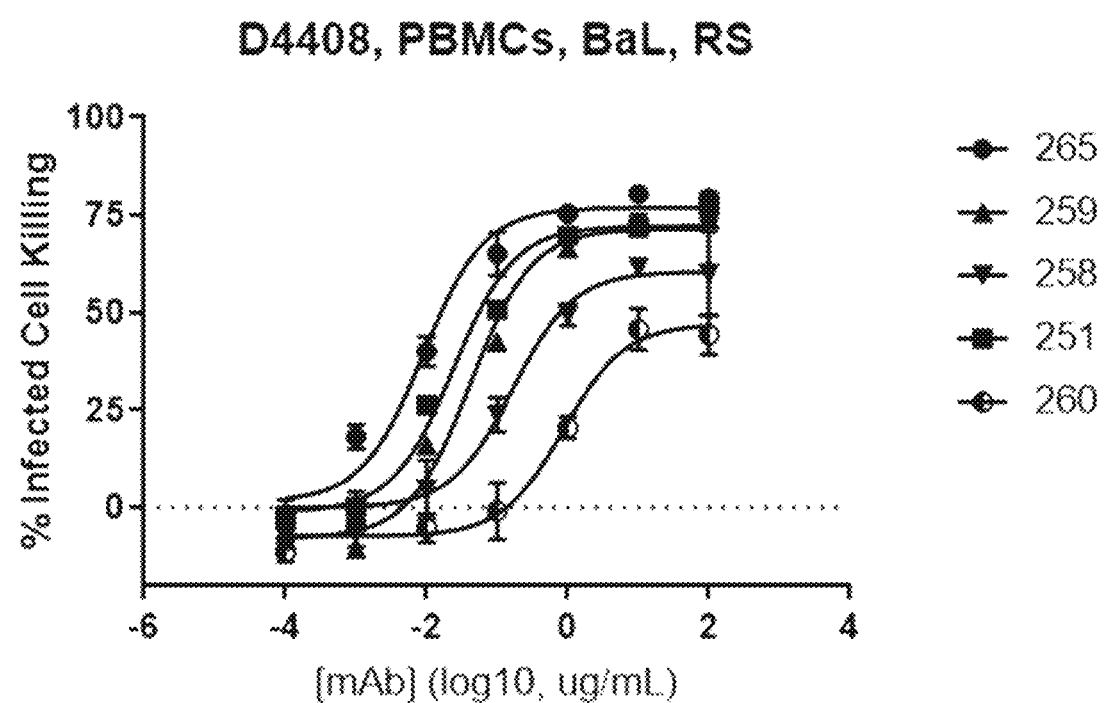
FIG. 19 illustrates a representative killing concentration-response curve by PGT121.66×huSP34 bispecific antibodies 265 (solid circle), 259 (upright triangle), 258 (inverted triangle), 251 (square), and 260 (half-solid circle) using PBMC effector cells.
Figure 20:
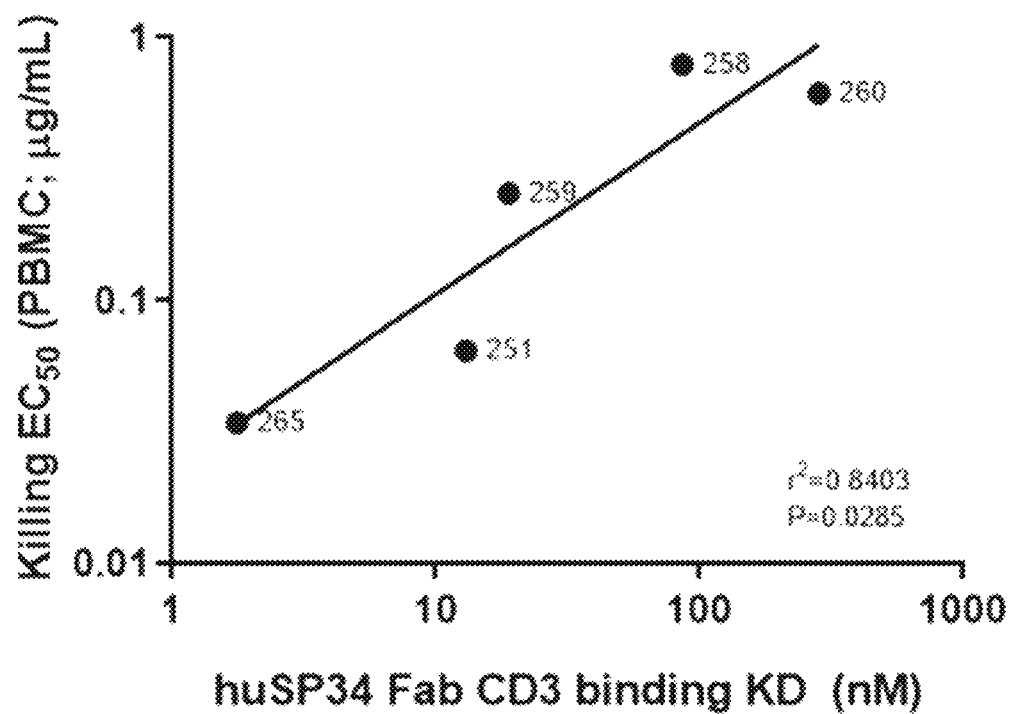
FIG. 20 illustrates a Pearson correlation of PGT121.66× huSP34 bispecific antibodies (from highest to lowest PBMC killing $EC_{50}$ value) 258, 260, 259, 251 and 265. huSP34 variant CD3 binding affinity vs. PBMC killing $EC_{50}$ values. The killing $EC_{50}$ value is the geometric mean $EC_{50}$ value of the 5 viruses tested with two donors.
Figure 21:
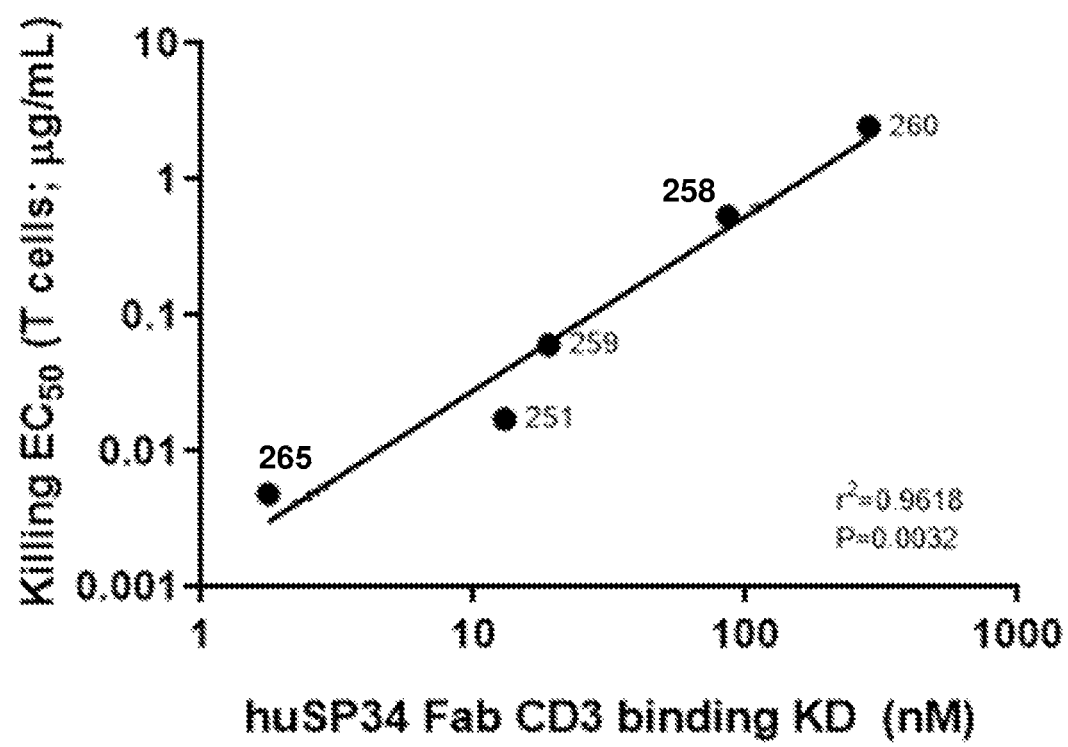
FIG. 21 illustrates a Pearson correlation of PGT121.66× huSP34 bispecific antibodies (from highest to lowest T cell killing $EC_{50}$ value) 260, 258, 259, 251 and 265. huSP34 variant CD3 binding affinity vs. isolated T cell killing $EC_{50}$ values. The killing $EC_{50}$ value is the geometric mean $EC_{50}$ value of the 5 viruses tested with two donors.

The results are displayed in Tables 41-42. FIG. 19 depicts a representative killing concentration-response curve (BaL-infected CEM-NKr-CCR5-LucR+ cells, PBMC effector cells, Donor 4408). Higher CD3 affinity was significantly correlated with lower (i.e., more potent) killing $EC_{50}$ values using either whole PBMCs (FIG. 20; $r^2$=0.8403, P=0.0285) or isolated T cells (FIG. 21; $r^2$=0.9618, P=0.0032) as effector cells. Thus, increasing CD3 affinity resulted in increased HIV×CD3 bispecific molecule-mediated killing potency.

The HIV-infected cell killing activity was evaluated using the CEM-NKr-CCR5-LucR+ lymphoblastoid reporter cell line infected with 5 different HIV-1 primary isolates as target cells and PBMCs from two healthy donors as effector cells. CEM-NKr-CCR5-LucR+ cells were infected for 3 days, washed and co-cultured with 3BNC117×CD3 bispecific molecules and PBMCs (25:1 effector:target cell ratio) for 2 days and expression of tat-driven luciferase was quantified

TABLE 41

Killing $EC_{50}$ Values (μg/mL) of HIV-Infected CEM-NKr-CCR5-LucR Reporter Cells Using PBMC Effector Cells
$EC_{50}$s - PBMCs (μg/ml)

| Ab \| Isolate | Donor | | | | | | | | | |
|---|---|---|---|---|---|---|---|---|---|---|
| | 4560 | 4408 | 4560 | 4408 | 4560 | 4408 | 4560 | 4408 | 4560 | 4408 |
| | 7552 | | 8398 | | Bal | | 1489 | | 727 | |
| 265 | 0.269 | 0.002 | 0.063 | 0.009 | 0.080 | 0.008 | 0.085 | 0.019 | 0.197 | 0.039 |
| 251 | 0.098 | 0.027 | 0.248 | 0.028 | 0.072 | 0.026 | 0.176 | 0.015 | 0.207 | 0.072 |
| 259 | 0.611 | 0.074 | 0.500 | 0.105 | 0.317 | 0.064 | 0.563 | 0.106 | 1.268 | 0.355 |
| 258 | 0.371 | 0.529 | 1.796 | 0.325 | 1.598 | 0.164 | 1.469 | 0.778 | 6.220 | 0.465 |
| 260 | 0.373 | 0.113 | 14.950 | 9.168 | 0.003 | 1.308 | 17.060 | 2.216 | 0.005 | 1.874 |

TABLE 42

Killing $EC_{50}$ Values (μg/mL) of HIV-Infected CEM-NKr-CCR5-LucR Reporter Cells Using Isolated T cell Effector Cells.
$EC_{50}$s - T Cells (μg/ml)

| Ab \| Isolate | Donor | | | | | | | | | |
|---|---|---|---|---|---|---|---|---|---|---|
| | 4560 | 4408 | 4560 | 4408 | 4560 | 4408 | 4560 | 4408 | 4560 | 4408 |
| | 7552 | | 8398 | | Bal | | 1489 | | 727 | |
| 265 | 0.014 | 0.001 | 0.008 | 0.002 | 0.005 | 0.001 | 0.016 | 0.007 | 0.015 | 0.004 |
| 251 | 0.123 | 0.004 | 0.018 | 0.011 | 0.010 | 0.005 | 0.033 | 0.042 | 0.032 | 0.011 |
| 259 | 0.158 | 0.064 | 0.081 | 0.032 | 0.043 | 0.013 | 0.110 | 0.141 | 0.082 | 0.039 |
| 258 | 0.512 | 0.774 | 0.467 | 0.328 | 0.349 | 0.167 | 0.797 | 1.082 | 1.096 | 0.633 |
| 260 | 1.125 | 1.508 | 4.234 | 4.026 | 1.023 | 0.496 | 3.581 | 7.090 | 1.009 | 20.730 |

The influence of CD3 affinity on CD3-bispecifics killing activity was assessed using HIV×CD3 bispecific molecules created using h3BNC117.52.64 as the Env-targeting arm and huSP34 (in scFv format) with a range of CD3 affinities as previously determined by BLI. The equilibrium dissociation constant (KD) of the CD3 Fabs used for creating the HIV×CD3 molecules are presented in Table 43.

TABLE 43

3BNC117 × CD3 Bispecific Panel and CD3 Binding Affinity for Corresponding huSP34 Fab Variant

| Ab Name | huSP34 Fab - $K_D$ (nM) |
|---|---|
| 237 | 2.49 |
| 230 | 13 |
| 238 | 45.3 | using One-Glo luciferase reagent (Promega). The percent infected cell killing was calculated using the following equation:

100−((RLU of HIV-infected target cells in treated wells/RLU HIV-infected target cells in untreated wells)*100).

For concentration-response curves that had an apparent $E_{max}$<20%, the $E_{max}$ values were reported as <20% and the $EC_{50}$ values reported as >100 μg/mL (maximum concentration tested).

Figure 22:
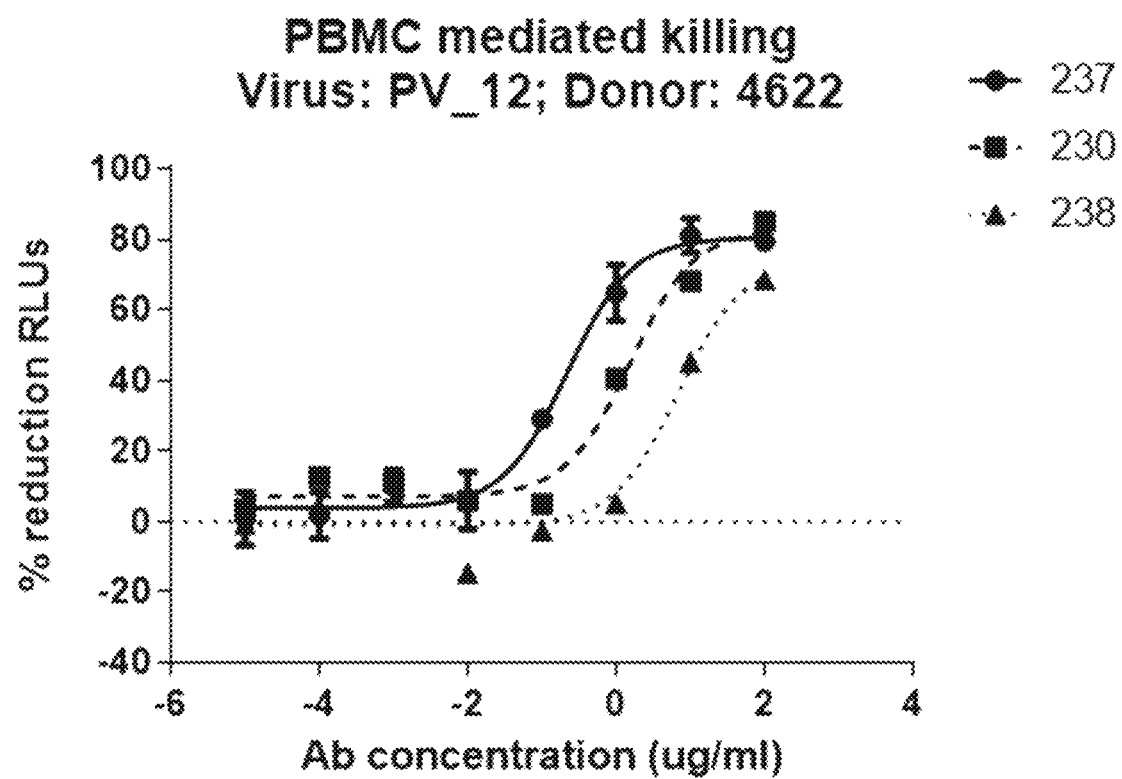
FIG. 22 illustrates a representative concentration-response curve of killing by 3BNC117.52.64×huSP34 bispecific antibodies 237 (circle), 230 (square) and 232 (triangle) using PBMC effector cells.
Figure 23:
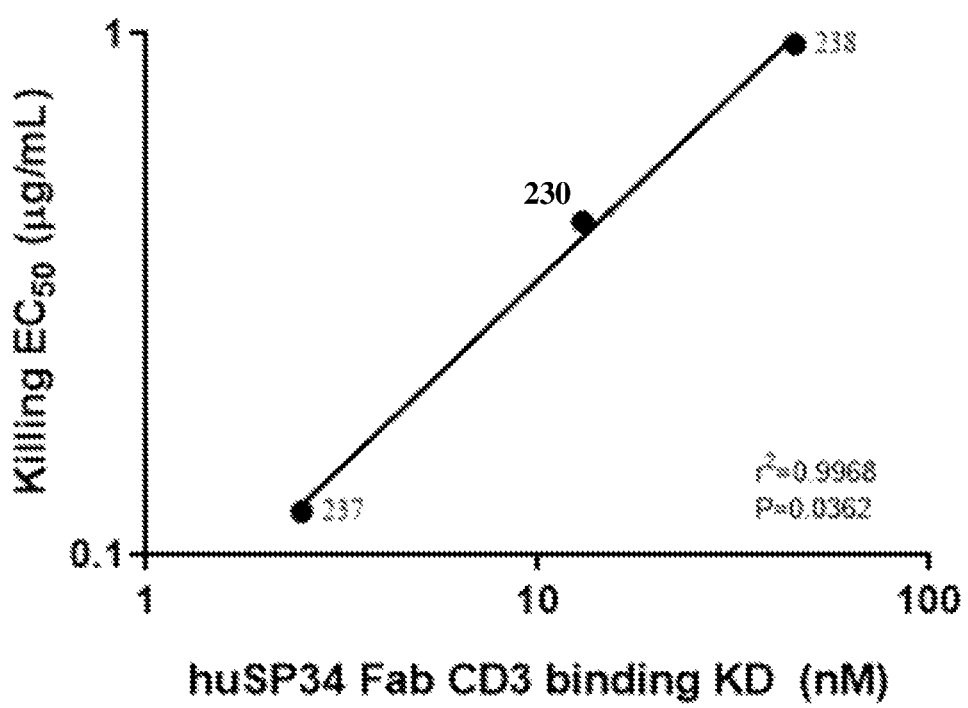
FIG. 23 illustrates a Pearson correlation of 3BNC117.52.64×CD3 bispecific antibodies (from highest to lowest PBMC cell killing $EC_{50}$ value) 238, 230 and 237. huSP34 variant CD3 binding affinity vs. PBMC killing $EC_{50}$ values. The killing $EC_{50}$ value is the geometric mean $EC_{50}$ value of the 5 viruses tested with two donors.

The results are displayed in Table 44. FIG. 22 depicts a representative killing concentration-response curve (PV_12-infected cells, Donor 4622). Higher CD3 affinity was significantly correlated with lower killing $EC_{50}$ values (FIG. 23; $r^2$=0.9968, P=0.0362). Thus, increasing CD3 affinity resulted in increased HIV×CD3 bispecific molecule-mediated killing potency.

TABLE 44

Killing EC$_{50}$ Values (μg/mL) of HIV-Infected
CEM-NKr-CCR5-LucR Reporter Cells.

EC$_{50}$s - (μg/ml)

| | Donor | | | | | | | | | |
|---|---|---|---|---|---|---|---|---|---|---|
| Ab \| Isolate | 4622 PV_E1 | 4359 | 4622 PV_E3 | 4359 | 4622 PV_12 | 4359 | 4622 PV_13 | 4359 | 4622 PV_19 | 4359 |
| 237 | 1.34 | 0.01 | 0.22 | 0.67 | 0.02 | 0.33 | | 0.09 | 0.49 | 0.01 |
| 230 | 3.21 | 0.06 | 1.57 | 4.32 | 0.10 | 2.00 | 0.02 | 0.44 | 2.74 | 0.04 |
| 238 | >100 | 0.18 | 6.93 | 23.40 | 0.31 | 0.16 | 0.08 | 1.91 | 20.48 | 0.15 |

Example 11

In Vitro Killing of HIV-Infected Primary Cells or CEM Cells

PBMCs were isolated by ficoll separation from leukopaks from healthy donors (HIV-/HBV-/HCV-) and rested overnight. CD4+ T cells were isolated using the Stemcells EasySep Human CD4+ T Cell Enrichment Kit (Cat #19052). Isolated CD4+ T cells were spinfected with HIV isolates at 1200×g for 2 hrs and then cultured for 5 days to allow for de novo expression. Target cells were washed and 200,000 cells/well were plated and co-cultured with CD3-bsAb and 600,000 FITC membraned stained (Sigma Aldrich Cat #PKH67GL) PBMCs/well and incubated for 2 day. Cells were washed and stained with live/dead membrane stain (Thermo Fisher Cat #L34966) and a-CD4-BV711 (BD Biosciences Cat #563028). Cells were then fixed/permeabilized and stained with a-p24-PE (Beckman Coulter Cat #6604667) and read on a flow cytometer (BD LSRFortessa). The percent reduction in p24+CD4- live target cells was measured and quantified using the following equation:

100-((% *p24+CD4-* live target cells in treated
wells/% *p24+CD-* live target cells in untreated
wells)*100).

Figure 24:
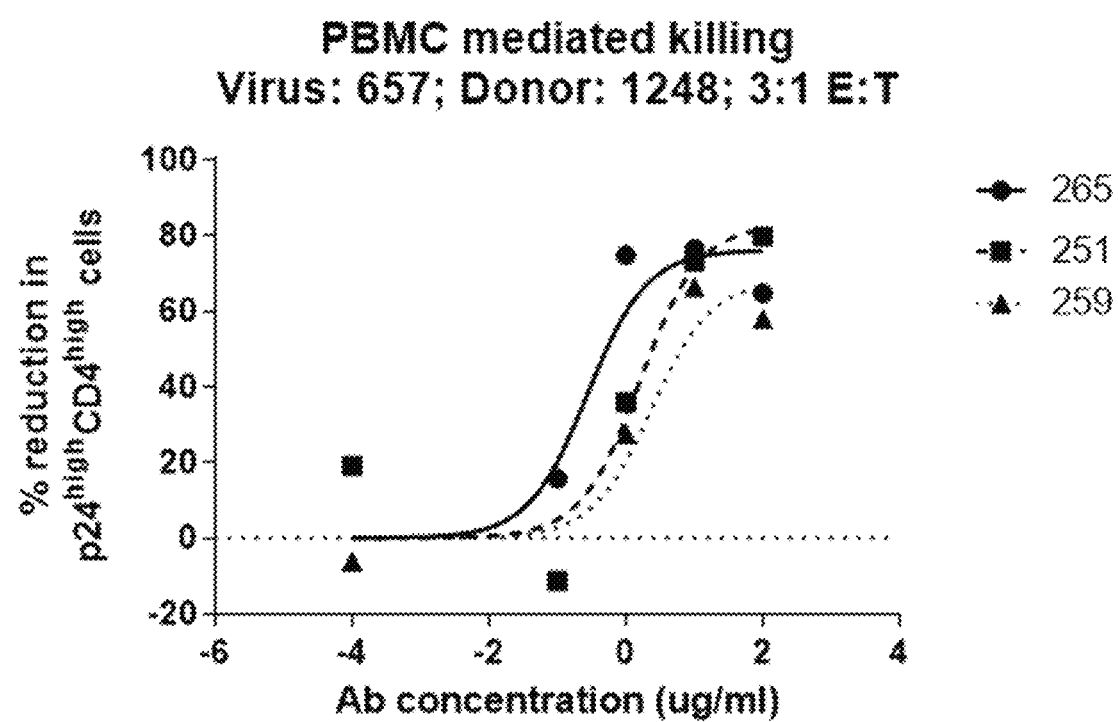
FIG. 24 illustrates a representative killing concentration-response curve of primary HIV-infected (virus 657) CD4+ cells by PGT121.66×huSP34 bispecific molecules 265 (circle) 251 (square) and 259 (triangle) using PBMC effector cells (E:T=3:1).
Figure 25:
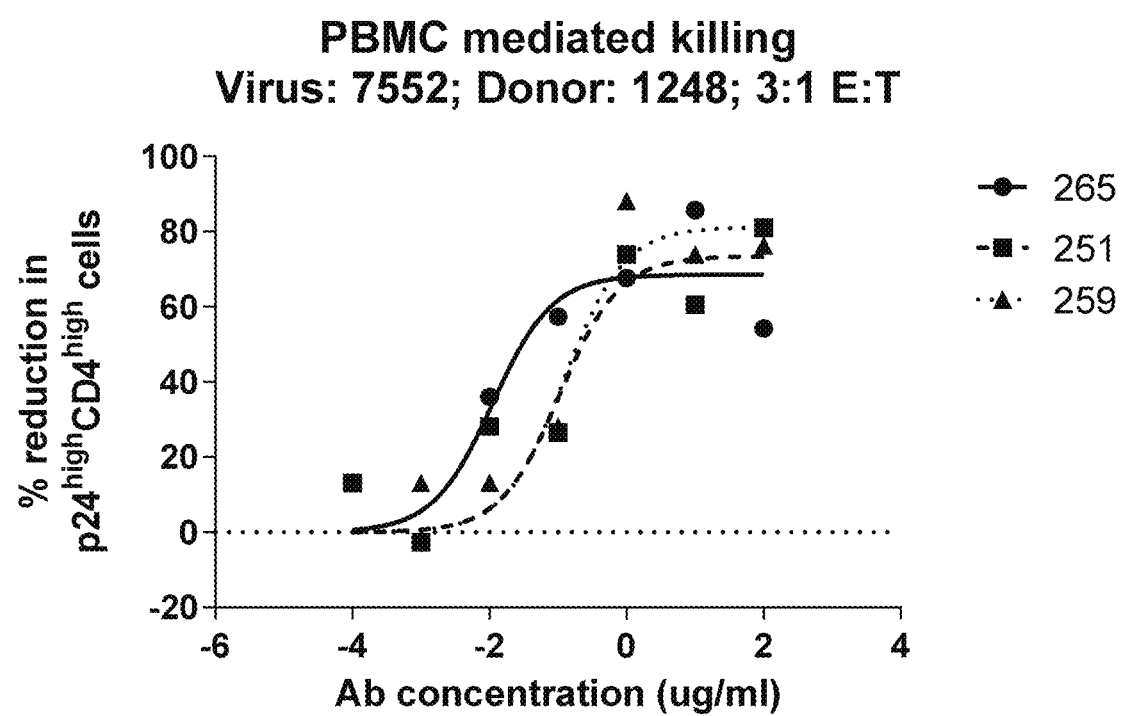
FIG. 25 illustrates a representative killing concentration-response curve of primary HIV-infected (virus 7552) CD4+ cells by PGT121.66×huSP34 bispecific molecules 265 (circle) 251 (square) and 259 (triangle) using PBMC effector cells (E:T=3:1).

A panel of bispecific molecules was generated with a-CD3 SP34 derived sequences that had a range of affinities measured by SPR and the competition FACs assays and a common a-HIV envelope sequence. To determine if there was a correlation between the initially derived affinities of the α-CD3 SP34 derived sequences and the antibody mediated cytotoxicity, the bispecific molecules were run in the primary cell killing assay with CD4 cells infected with 2 different HIV isolates and autologous PBMCs obtained from a single donor. The results are depicted in FIGS. 24 and 25, and summarized in Table 45.

PGT121.66×CD3 Bispecific Antibodies—CD3 Affinity Correlation to Primary Killing

TABLE 45

EC$_{50}$s values (μg/ml) of Primary HIV-infected CD4+ Cells by
PGT121.66 × huSP34 Bispecific Antibodies Using PBMC Effector Cells.

EC$_{50}$ (μg/ml)

| Ab \| Isolate | 657 | 7552 |
|---|---|---|
| 265 | 0.275 | 0.011 |
| 251 | 1.610 | 0.107 |
| 259 | 2.368 | 0.123 |

CD4ECD×CD3 Bispecific Molecule Evaluation—Killing of HIV-Infected CEM-NKr-CCr5-LucR+ CD4+ T Cells In Vitro.

To identify the CD4×α-CD3 bispecific formats that confer optimal redirected killing activity, we generated a panel of molecules with CD4 arm varying in domain composition or valency, paired with huSP34 in scFv or Fab format (Table 46, FIGS. 7B-7D).

TABLE 46

A Panel of CD4 ECD × α-CD3 Bispecific
Molecules Format Evaluation.

| | CD4 arm | | huSP34 arm |
|---|---|---|---|
| Ab name | domain | valency | format |
| 212 | D1D2 | 1 | ScFv |
| 211 | D1D2 | 1 | Fab |
| 213 | D1D2 | 2 (bivalent) | ScFv |
| 198 | D1.22 | 2 (tandem) | ScFv |
| 187 | D1.22 | 1 | Fab |
| 199 | D1.22 | 2 (bivalent) | ScFv |
| 186 | D1.22 | 1 | Fab |

The HIV-infected cell killing activity was evaluated using the CEM-NKr-CCR5-LucR+ lymphoblastoid reporter cell line infected with 3 different HIV-1 primary isolates as target cells and PBMCs from two healthy donors as effector cells. CEM-NKr-CCR5-LucR+ cells were infected for 3 days, washed and co-cultured with CD4×α-CD3 bispecific molecules and PBMCs (25:1 effector:target cell ratio) for 2 days and expression of tat-driven luciferase was quantified using One-Glo luciferase reagent (Promega). The percent infected cell killing was calculated using the following equation:

100-((RLU of HIV-infected target cells in treated
wells/RLU HIV-infected target cells in
untreated wells)*100).

For concentration-response curves that had an apparent $E_{max}$<20%, the $E_{max}$ values were reported as <20% and the EC$_{50}$ values reported as >100 μh/mL (maximum concentration tested).

Figure 26:
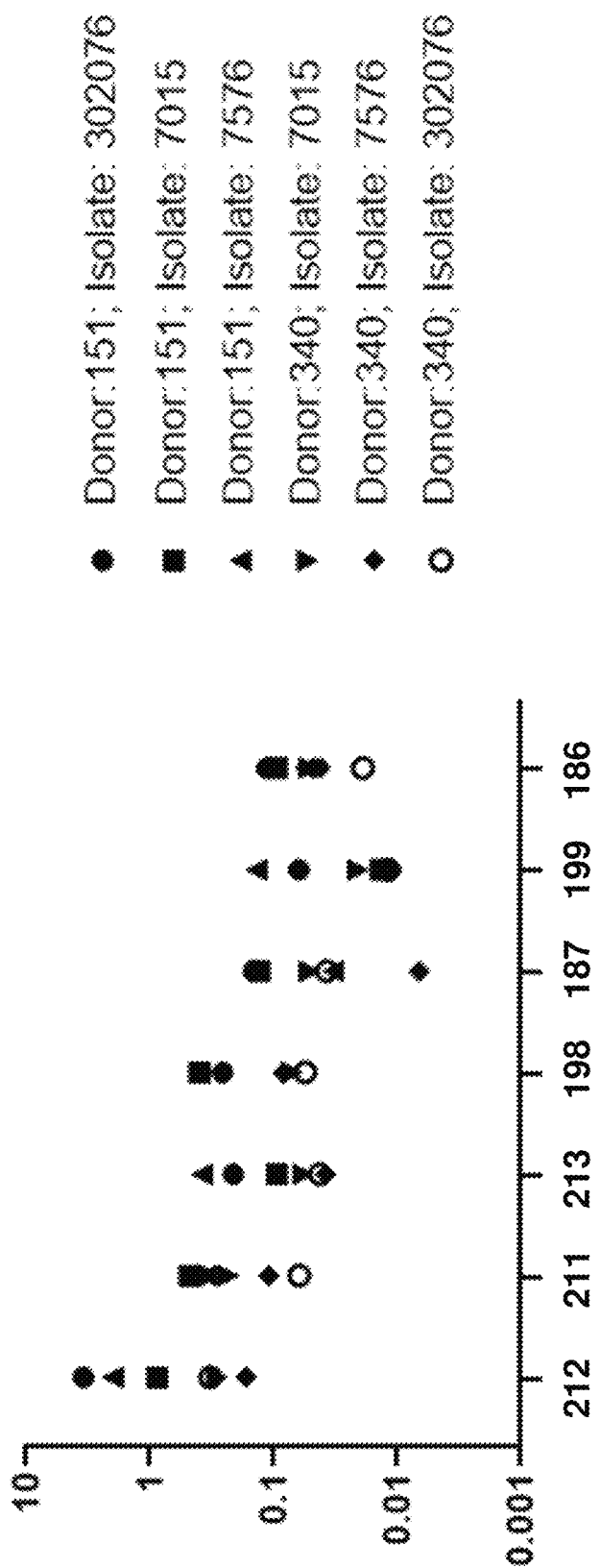
FIG. 26 illustrates $EC_{50}$ values of killing curves plotted across CD4 ECDxα-CD3 bispecific molecules (from right-to-left: 212, 211, 213, 198, 187, 199 and 186). The geomean $EC_{50}$ value for each molecule (-) calculated from all viruses/donors are shown.

Table 47 and FIG. 26 summarize the EC50 values calculated from the killing curves for each bispecific test article against all three virus isolates by two donor PBMCs. Mean EC50 values for this panel range from 0.026 to 0.684 μg/ml. When different CD4 targeting domains were employed in otherwise identical molecules, namely D1.22 vs. D1D2 (e.g., 187 vs. 211, 199 vs. 213), EC$_{50}$ values were about 4-5-fold lower for D1.22-containing molecules, suggesting D1.22 is a more effective targeting arm for HIV-infected cells than their two-domain counterpart. The EC$_{50}$ value of 212 was ~3-fold higher than that of 211; these two molecules employed identical CD4 targeting arm but varied in their huSP34 domain format (scFv vs. Fab), indicating huSP34 conferred more potent killing activity in scFv format than in Fab format in the context of these two molecules. When comparing $EC_{50}$ values of molecules harboring CD4 domains varying in valency and spatial arrangement, the result suggested that bivalent CD4 domain is more effective in targeting HIV-infected cells than their monovalent counterpart (e.g., 213 vs. 212), and that for molecules with two copies of CD4 domain, the "bivalent" configuration confers more potent killing activity than the "tandem" configuration (e.g., 199 vs. 198) (defined in FIG. 7D; Example 2).

TABLE 47

Killing $EC_{50}$ Values (µg/mL) of HIV-Infected CEM-NKr-CCR5-LucR Reporter Cells.
$EC_{50}$s (µg/ml)

| Ab \| Isolate | Donor 151 302076 | 340 | 151 7015 | 340 | 151 7576 | 340 | Geomean (all donors/ viruses) |
|---|---|---|---|---|---|---|---|
| 212 | 3.514 | 0.330 | 0.878 | 0.294 | 2.032 | 0.169 | 0.684 |
| 211 | 0.404 | 0.063 | 0.485 | 0.236 | 0.353 | 0.110 | 0.220 |
| 213 | 0.214 | 0.043 | 0.095 | 0.059 | 0.382 | 0.038 | 0.095 |
| 198 | 0.263 | 0.057 | 0.402 | 0.072 | 0.398 | 0.085 | 0.156 |
| 187 | 0.147 | 0.038 | 0.130 | 0.052 | 0.033 | 0.007 | 0.045 |
| 199 | 0.063 | 0.012 | 0.014 | 0.021 | 0.138 | 0.011 | 0.026 |
| 186 | 0.115 | 0.019 | 0.095 | 0.052 | 0.056 | 0.042 | 0.054 |

CD4 ECDxCD3 Bispecific Molecule-Mediated Killing of Primary CD4+ T Cells Infected with Different HIV Isolates Killing of HIV infected cells by bispecific molecule 180 was evaluated and demonstrated in primary cell killing assays using primary CD4+ T cells that were infected with a panel of HIV isolates and autologous PBMCs as effector cells. Bispecific molecule 180 was tested alone or in combination with the bNAbs PGT121.42 (described in WO2017/106346) or h3BNC117.52.64 (described in WO2020/010107). To perform the assays, PBMCs were isolated by ficoll separation from leukopaks from healthy donors (HIV-/HBV-/HCV-) and rested overnight. CD4 cells were then isolated using the Stemcells EasySep Human CD4+ T Cell Enrichment Kit (Cat #19052). Isolated CD4 cells were spinfected with HIV isolates at 1200×g for 2 hrs and then cultured for 5 days to allow for de novo expression. Target cells were washed and 200,000 cells/well were plated and co-cultured in the presence or absence of different concentrations of the indicated antibodies with 600,000 FITC membraned stained (Sigma Aldrich Cat #PKH67GL) PBMCs/well for 2 days. Cells were washed and stained with live/dead membrane stain (Thermo Fisher Cat #L34966) and anti-CD4-BV711 (BD Biosciences Cat #563028). Cells were then fixed/permeabilized and stained with anti-p24-PE (Beckman Coulter Cat #6604667) and analyzed on a flow cytometer (BD LSRFortessa). p24+CD4– live target cells were quantified for each condition and the percent reduction in p24+CD4– live target cells relative to the control (no antibody) was determined using the following equation:

$$100-((\% \, p24{+}CD4{-} \text{ live target cells in treated wells}/\% \, p24{+}CD{-} \text{ live target cells in untreated wells})*100).$$

Figure 27:
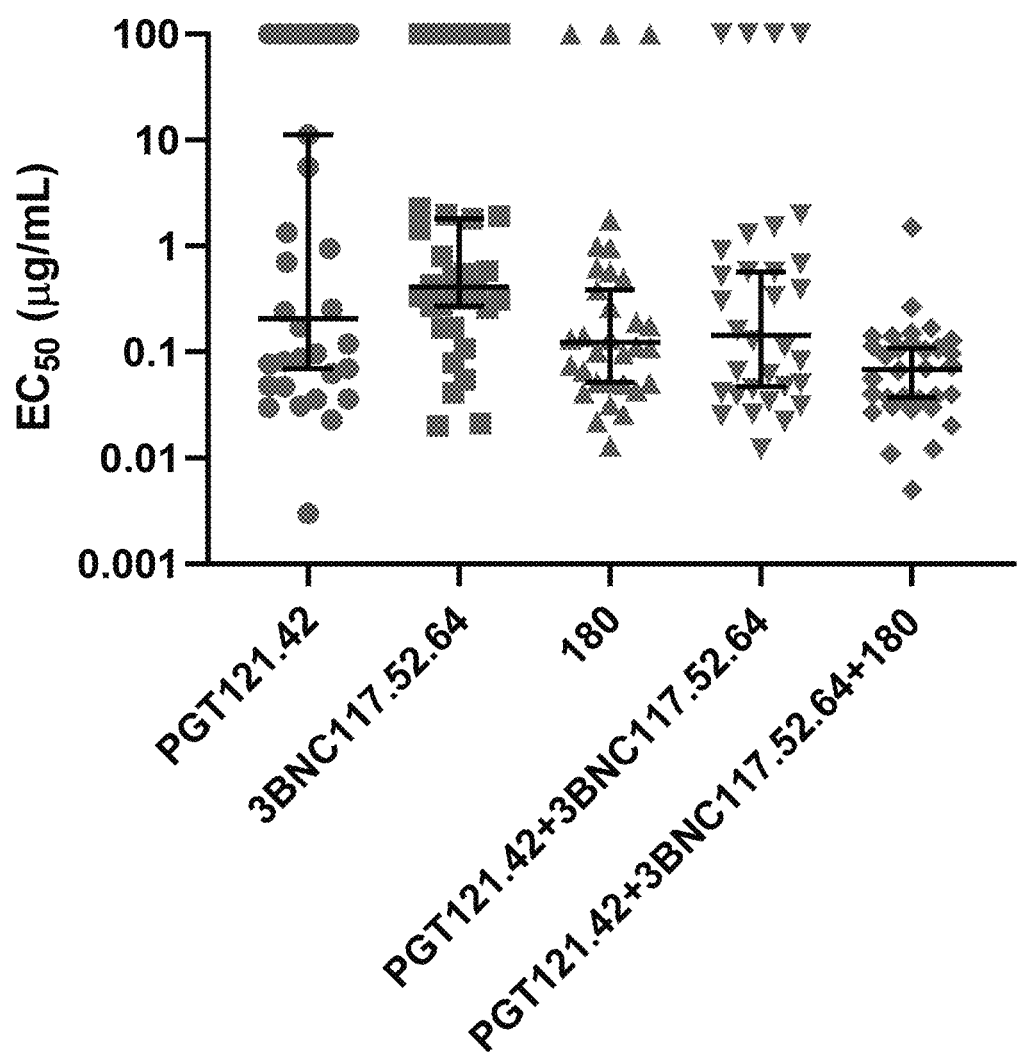
FIG. 27 illustrates antibody- and bispecific-mediated killing of primary CD4+ T cells infected with different HIV isolates. Primary CD4+ T cells were infected with a panel of 32 HIV isolates and incubated with the antibodies or antibody combinations indicated and autologous PBMCs as effector cells. Data on the graph represents the $EC_{50}$ values determined in the killing assay for each HIV isolate and antibody, bispecific or antibody/bispecific combination (from left to right: PGT121.42, h3BNC117.52.64, bispecific 180, PGT121.42+h3BNC117.52.64 combination, PGT121.42+h3BNC117.52.64+bispecific 180 combination. Horizontal bars indicate the median and 95% confidence intervals.

These results were used to determine killing $EC_{50}$ values for each antibody or antibody combination. Effective killing was defined as an $EC_{50}$ value of less than 50 µg/mL. As shown in FIG. 27 and Table 48, PGT121.42 and h3BNC117.52.64 mediated killing of CD4+ T cells infected with 23/32 and 26/32 of the HIV isolates tested, respectively, with median $EC_{50}$ values of 0.21 and 0.41 µg/mL, respectively. Bispecific molecule 180 mediated killing of CD4+ T cells infected with 29/32 of the HIV isolates tested with a median $EC_{50}$ value of 0.12 µg/mL. Combining the bNAbs PGT121.42 and h3BNC117.52.64 in the assay mediated killing of CD4+ T cells infected with 28/32 of the HIV isolates tested with a median $EC_{50}$ value of 0.14 µg/mL. When all three bispecific molecules were combined in the assay, PGT121.42, h3BNC117.52.64 and bispecific 180 mediated killing of CD4+ T cells infected with all 32 of the HIV isolates tested with a median $EC_{50}$ value of 0.069 µg/mL (FIG. 27, Table 48). Based on these data, the triple combination was the most effective regimen tested in the in vitro killing assay as demonstrated by improved HIV isolate coverage and killing potency.

TABLE 48

Antibody-/Bispecific-Mediated Killing of Primary CD4+ T cells Infected with Different HIV Isolates Using Autologous PBMCs as Effector Cells.
$EC_{50}$ (µg/mL)

| Virus | PGT121.42 | h3BNC117.52.64 | 180 | h3BNC117.52.64 + PGT121.42 | h3BNC117.52.64 + PGT121.42 + 180 |
|---|---|---|---|---|---|
| 1003 | 0.945 | 0.277 | 0.192 | 0.563 | 0.141 |
| 1413 | 100 | 0.317 | 0.624 | 0.905 | 0.070 |
| 7007 | 0.063 | 0.020 | 0.052 | 0.334 | 0.150 |
| 7015 | 0.096 | 0.579 | 0.265 | 0.111 | 0.129 |
| 7046 | 0.036 | 100 | 0.100 | 0.034 | 0.067 |
| 7103 | 0.003 | 0.318 | 0.384 | 0.045 | 0.038 |
| 7141 | 0.070 | 0.434 | 0.133 | 0.041 | 0.040 |
| 7467 | 0.030 | 0.021 | 0.041 | 0.022 | 0.027 |
| 7576 | 0.081 | 0.167 | 0.066 | 0.061 | 0.030 |
| 7595 | 0.705 | 1.435 | 0.013 | 0.160 | 0.012 |
| 7714 | 100 | 100 | 0.140 | 100 | 0.168 |
| 8084 | 11.290 | 1.984 | 100 | 1.294 | 0.140 |
| 8089 | 0.077 | 0.260 | 100 | 0.025 | 0.011 |
| 8106 | 0.047 | 0.507 | 0.026 | 0.012 | 0.005 |
| 8110 | 0.256 | 2.297 | 0.177 | 0.302 | 0.264 |
| 8134 | 0.119 | 0.079 | 0.051 | 0.047 | 0.038 |
| 8176 | 0.031 | 0.171 | 0.993 | 0.031 | 0.056 |
| 8320 | 1.334 | 0.335 | 0.494 | 0.679 | 0.109 |
| 8331 | 0.172 | 0.269 | 0.133 | 0.127 | 0.120 |
| 8339 | 100 | 0.393 | 0.075 | 0.570 | 0.074 |

TABLE 48-continued

Antibody-/Bispecific-Mediated Killing of Primary CD4+ T cells Infected
with Different HIV Isolates Using Autologous PBMCs as Effector Cells.
$EC_{50}$ (µg/mL)

| Virus | PGT121.42 | h3BNC117.52.64 | 180 | h3BNC117.52.64 + PGT121.42 | h3BNC117.52.64 + PGT121.42 + 180 |
|---|---|---|---|---|---|
| 302076 | 100 | 1.799 | 1.771 | 1.520 | 1.502 |
| BaL | 0.048 | 0.055 | 0.050 | 0.039 | 0.031 |
| PV10 | 100 | 100 | 0.052 | 100 | 0.036 |
| PV57 | 0.023 | 0.312 | 0.969 | 0.050 | 0.020 |
| PV58 | 100 | 0.799 | 0.096 | 0.520 | 0.103 |
| PV59 | 100 | 1.912 | 0.111 | 1.960 | 0.113 |
| PV61 | 0.241 | 100 | 0.032 | 0.389 | 0.093 |
| PV63 | 0.036 | 0.107 | 0.570 | 0.026 | 0.037 |
| PV65 | 0.088 | 0.547 | 100 | 0.082 | 0.106 |
| PV70 | 100 | 100 | 0.022 | 100 | 0.097 |
| PV72 | 100 | 100 | 0.113 | 100 | 0.029 |
| PVE2 | 5.557 | 0.041 | 0.043 | 0.065 | 0.040 |

Example 12

Characterization of Infected CEM Cell Binding In Vitro

We evaluated the binding of three HIV×α-CD3 bispecific molecules harboring different Env-targeting specificities to surface expressed Env on HIV-infected cells (Table 49).

TABLE 49

Bispecific Molecules Evaluated in this Example.

| Bispecific Name | Features |
|---|---|
| 186 | hCD4 D1.22 Fc AAS + W/huSP34.1.3 AAS + SAV + R |
| 255 | hPGT121.66 W/huSP34.1.3scFv SAV + R |
| 230 | h3BNC117.52.64 AAS + W/huSP34.1.3scFv AAS + SAV + R |

The HIV-infected cell binding activity was evaluated using the CEM-NKr-CCR5-LucR+ lymphoblastoid reporter cell line infected with 24 different HIV-1 primary isolates. CEM-NKr-CCR5-LucR+ cells were infected for 3 days, washed and co-incubated with different concentrations of HIV×α-CD3 bispecific molecules for 1 hour. Cells were then washed and stained with α-huIgG-APC (Jackson ImmunoResearch Cat #109-136-098), α-CD4-BV711 (BD Biosciences Cat #563028), and a-CD8-APC-Cy7 (BD Biosciences Cat #560179). Cells were then washed, fixed/permeabilized and analyzed using a BD LSRFortessa instrument. The percentage of cells that were α-huIgG-APC positive as well as the mean fluorescence intensity (mFI) values of α-huIgG-APC of all samples were collected. Binding curves were generated and $EC_{50}$ values analyzed using GraphPad Prism.

Figure 28:
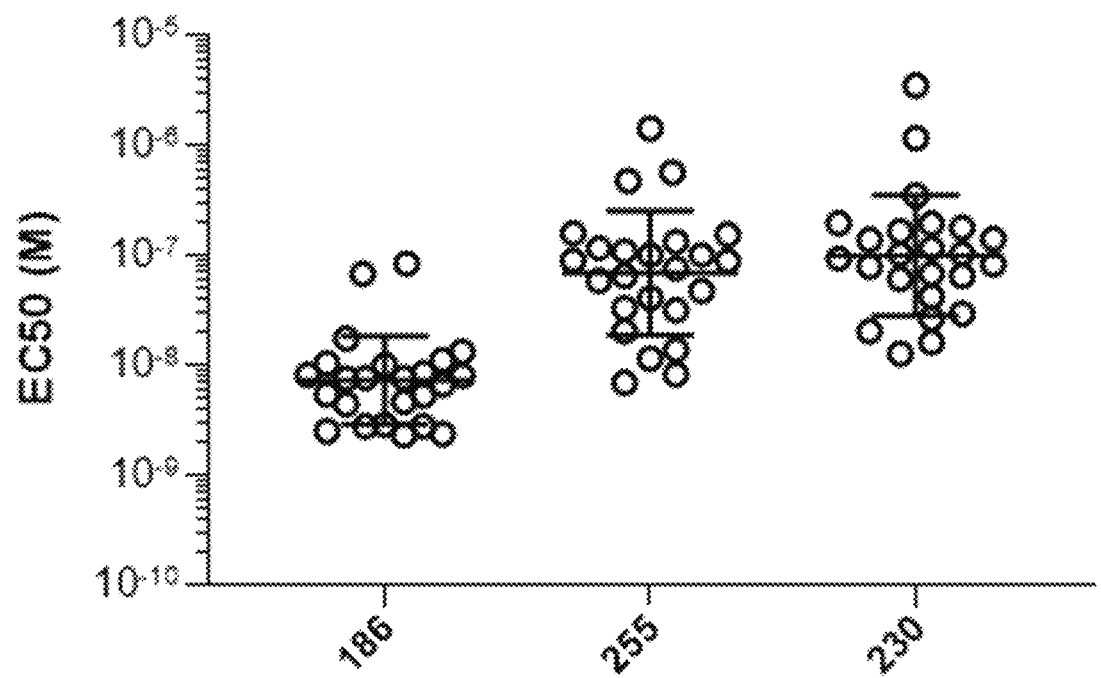
FIG. 28 $EC_{50}$ values of binding curves for 24 virus isolate-infected cells plotted across test bispecific molecules 186, 255 and 230.
Figure 29:
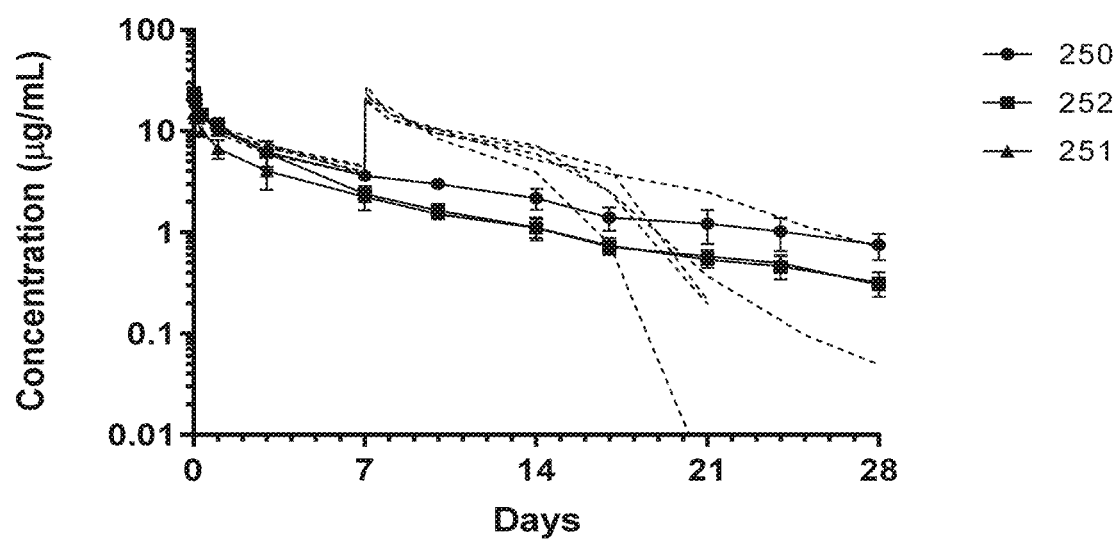
FIG. 29 illustrates pharmacokinetic (PK) profiles for PGT121.66×huSP34 bispecific molecules 250 (circle), 252 (square), and 251 (triangle) dosed at 1 mg/kg IV to naïve male cynomolgus monkeys (n=3). For comparison, dose normalized individual monkey PK profiles for Comparator #7 bispecific (dashed lines) dosed at 30 mg/kg IV on Day 0 and 7. Each symbol is the measured mean±standard deviation (SD) serum concentration.

As summarized in FIG. 28 and Table 50, bispecific molecules 186 and 180, bearing the CD4 D1.22 Env-targeting arm, exhibited the highest binding potency against HIV-1-infected CEM-NKrCCRS-LucR+ cells with a geometric mean of the $EC_{50}$ values of all isolates tested of 7.2 nM and 21.39, respectively, while the geometric means of the $EC_{50}$ values for bispecific molecules 255 and 230 were 68.8 nM and 99.1 nM, respectively. This result demonstrated that all four Env-binding specificities bind to HIV Env expressing cells and that the CD4 D1.22 domain exhibits the most potent binding affinity when evaluating this panel of HIV isolates.

TABLE 50

$EC_{50}$ Values of Binding Curves for 24 Virus Isolate-Infected Cells of Four Bispecific Molecules Tested.
$EC_{50}$ (mFI) of α-huIgG+ (nM)

| Ab | Isolate | 186 | 255 | 230 | 180 |
|---|---|---|---|---|
| PVE4 | 7.54 | 58.10 | 115.60 | 65.11 |
| PV72 | 8.16 | 89.13 | 196.30 | 66.86 |
| PV71 | 2.35 | 89.07 | 78.43 | 14.97 |
| PV23 | 4.62 | 47.12 | 102.30 | 15.40 |
| 302076 | 2.78 | 108.90 | 16.04 | 17.87 |
| 8339 | 66.90 | 132.80 | 29.05 | n/d* |
| 8331 | 83.55 | 100.30 | 60.32 | n/d |
| 8320 | 11.10 | 154.20 | 165.00 | 10.74 |
| PV59 | 9.99 | 477.50 | 139.80 | 7.31 |
| 7015 | 7.63 | 158.80 | 82.41 | n/d |
| 7141 | 2.50 | 11.41 | 194.70 | 12.82 |
| 7467 | 7.98 | 31.51 | 12.70 | 43.64 |
| 8318 | 17.35 | 115.50 | 142.30 | 5.60 |
| PV58 | 10.30 | 564.30 | 350.70 | 21.26 |
| 7015 | 2.86 | 1426.00 | 103.10 | n/d |
| 8110 | 5.28 | 75.48 | 64.44 | 11.30 |
| 7007 | 5.40 | 40.42 | 1156.00 | 62.13 |
| 7576 | 8.43 | 64.50 | 177.90 | 46.74 |
| 7103 | 6.65 | 6.92 | 41.88 | 30.87 |
| 8176 | 7.62 | 8.24 | 20.29 | 45.61 |
| PV62 | 2.77 | 100.00 | 67.05 | 15.16 |
| PV64 | 4.39 | 20.22 | 3509.00 | 10.73 |
| PV63 | 2.32 | 13.65 | 26.27 | 40.34 |
| PV66 | 13.11 | 32.62 | 92.99 | 14.13 |
| Geomean | 7.22 | 68.75 | 99.08 | 21.39 |

*n/d = not determined

Example 13

Pharmacokinetics of HIV-Targeted CD3 Bispecific Molecules

Selected anti-gp120 and CD4 D1.22 targeted anti-CD3 bispecific antibodies were administered by intravenous (IV) bolus injection to naïve male cynomolgus or rhesus macaque monkeys (Covance, TX) to characterize their PK and ADA profiles after single or repeat dosing. Serum samples collected from monkeys were analyzed using a selective bioanalytical method of sufficient sensitivity to determine serum concentration-time profiles and mean serum PK parameters by non-compartmental analysis (NCA). The bioanalytical method utilized clade B gp120 antigen (Immunetech, CA) as a capture reagent and biotin conjugated goat anti-human IgG antibody (Southern Biotech, AL) as a secondary reagent, with SULFOTAG labeled Streptavidin (MesoScale Discovery, MD) for electrochemical detection on a Mesoscale Discovery Quickplex SQ 120 plate reader. The serum concentration time profiles for anti-gp120×CD3 bispecific molecules are shown in FIGS. 29-32. CD4 D1.22× CD3 bispecific molecules serum concentration time profiles are shown in FIG. 33. Aberrant declines in exposure to levels below the limit of quantification was attributed to the formation of ADA and in certain instances aberrant concentration time points were removed from the PK analysis. The calculated NCA PK parameters for anti-gp120 and CD4 D1.22 targeted CD3 bispecific antibodies are presented in Tables 51 and 52, respectively.

The anti-gp120 antibody, PGT121.66, was evaluated in the context of a comparator bispecific platform containing the comparator #6 huSP34 variable domain (comparator 6 bispecific antibody). The comparator #6 bispecific antibody was found to have IgG-like PK (Cl≈12.5 mL/day/kg) in cynomolgus monkeys, but also a high rate of ADA in nearly every animal and context tested. The high rate of ADA was not mitigated by various common strategies such as repeat loading (up to 30 mg/kg), concomitant subcutaneous administration with the immunosuppressant methotrexate, or by chimerization with a simian IgG1 Fc, and the ADA was observed in both cynomolgus and rhesus monkeys. Introduction of FcRn enhancing mutations (LS and YTE) also did not reduce the ADA incidence or improve the exposure. Such a high rate of NHP ADA can limit the nonclinical pharmacological assessment and introduce unwanted immunogenicity related toxicities which may or may not be predictive of the clinical outcome thus complicating the development path.

Selected PGT121 scFv-Fc/Fab-Fc bispecific antibodies from the first and second round of huSP34 engineering were evaluated for PK and ADA in cynomolgus monkeys (Table 51). In all cases, the anti-gp120 binding domain was formatted as a Fab, while the huSP34 anti-CD3 epsilon binding domain was formatted as an scFv. In contrast to the representative Comparator 6 bispecific generated using an identical PGT121.66 anti-gp120 binding domain, and where all animals developed ADA (FIG. 29), the huSP34.1.3 scFv bispecifics 250, 252, and 251 were found to have comparable IgG-like PK and no incidence of ADA. The Cl for 250 (10.4 mL/day/kg) was slightly improved over 252 (14.1 mL/day/kg) and 251 (18.1 mL/day/kg) which have Fc mutations which remove Fc Protein A binding, but none of the huSP34.1.3 treated animals (n=9) had observable ADA. Modifications to increase the potency (FIG. 30) were found in some instances to increase the ADA incidence and reduce the exposure (264, 265, and 261). While Fc mutations to improve the PK such as LS had no impact (263), or a modest 2-fold improvement in the case of YTE (262), the higher potency variants generally had lower exposure and a higher rate of ADA. Bispecifics selected based on CD3 affinity and BVP ELISA results from the third round of huSP34 optimization were next evaluated in cynomolgus monkeys (FIG. 31). In contrast to previous literature reports (Leong et. al, 2017), there was no relationship of CD3 affinity and antibody clearance since the lowest potency bispecific 257 (Cl=10.5 mL/day/kg) had comparable clearance to the two highest CD3 affinity bispecifics 256 (10.7 mL/day/kg) and 243 (Cl=8.23 mL/day/kg). It was observed that the best correlate of PK outcome was with BVP score (Example 7).

The huSP34 variant 3.13 with the longest serum half-life and no detectable ADA (243) was further engineered to remove Protein A binding in the CD3 variable domain and scFv-Fc/Fab-Fc bispecific antibodies containing these variants were next evaluated in cynomolgus monkey (FIG. 32). Of the Protein A knockout bispecific variants evaluated 249 had the longest serum half-life (Cl=34.4 mL/day/kg), but reduced exposure (~4-fold) relative to 243. To confirm the excellent PK properties of the huSP34.3.13 variant it was evaluated in the context of a second anti-gp120 targeting bNAb (185). The bispecific 185 as was found to retain the excellent IgG-like PK properties (Cl=8.7 mL/day/kg).

TABLE 51

Non-Compartmental Analysis (NCA) of Anti-Gp120 × Anti-CD3 Bispecific Antibodies After IV Bolus Administration to Naïve Male Cynomolgus.

| Bispecific Name | Dose (mg/kg) | N | Cl (mL/day/kg) | Vz (mL/kg) | Half-life (day) | ADA |
|---|---|---|---|---|---|---|
| Comparator #6 | 30[a] | 5 | 12.5 ± 1.1* | 84.4 ± 7.40* | 4.70 ± 0.70* | 5 |
| 250 | 1 | 3 | 10.4 ± 1.78 | 133 ± 10.7 | 9.07 ± 1.56 | 0 |
| 252 | 1 | 3 | 14.1 ± 2.52 | 146 ± 17.0 | 7.26 ± 0.526 | 0 |
| 251 | 1 | 3 | 18.2 ± 2.84 | 203 ± 36.8 | 7.68 ± 0.273 | 0 |
| 265 | 1 | 3 | 21.6 ± 2.23* | 172 ± 53.0* | 5.46 ± 1.22* | 3 |
| 264 | 1 | 3 | 21.7 ± 1.97* | 178 ± 40.2* | 5.75 ± 1.58* | 3 |
| 261 | 1 | 3 | 18.4 ± 1.98 | 158 ± 43.8 | 5.89 ± 0.999 | 1 |
| 262 | 1 | 3 | 10.2 ± 2.42* | 100 ± 25.2* | 7.37 ± 3.49* | 3 |
| 263 | 1 | 3 | 17.8 ± 3.68* | 146 ± 93.7* | 5.41 ± 2.47* | 3 |
| 257 | 1 | 2 | 10.5 | 97.7 | 6.41 | 0 |
| 274 | 1 | 2 | 23.3 | 152 | 4.57 | 0 |
| 273 | 1 | 2 | 43.6 | 280 | 4.45 | 0 |
| 275 | 1 | 2 | 45.2 | 395 | 6.14 | 0 |
| 256 | 1 | 2 | 10.7 | 84.1 | 5.47 | 1 |
| 243 | 1 | 2 | 8.23 | 71.2 | 5.98 | 0 |
| 249 | 1 | 2 | 34.4 | 216 | 6.41 | 0 |
| 276 | 1 | 2 | 58.7 | 376 | 4.35 | 0 |
| 277 | 1 | 2 | 59.7 | 314 | 4.47 | 0 |
| 218 | 1 | 3 | 8.73 ± 2.27 | 129 ± 45.5 | 11.0 ± 6.12 | 1 |

[a]Dosed on day 0 and day 7
*PK analysis impacted by evidence of ADA

Next, ECD-Fc/Fab-Fc bispecific antibodies incorporating the CD4 D1.22 ECD and huSP34 variant Fabs were tested in NHP PK studies. These molecules were generated with and without Fc mutations designed to enhance pH dependent FcRn binding and with huSP34.1.3 or huSP34.3.13 anti- CD3 binding arms, or variants thereof containing variable domain Protein A knockout mutations (Table 52 and FIG. 33). Variants with (187) or without (186) FcRn mutations had comparable IgG-like PK, with Cl of 12.0 and 13.3 mL/day/kg, respectively. In contrast to the results obtained with the scFv-Fc/Fab-Fc bispecific antibodies incorporating the PGT121 derived anti-gp120 targeting domain, ECD-Fc/Fab-Fc variants with (180) or without (185) huSP34 variable domain Protein A knockout mutations showed comparable IgG-like PK with Cl of 14.4 and 17.0 mL/day/kg, respectively.

TABLE 52

NCA of CD4 × Anti-CD3 Bispecific Antibodies After 1 mg/kg IV Bolus Administration to Naive Male Cynomolgus Monkeys.

| Bispecific Name | Dose (mg/kg) | N | Cl (mL/day/kg) | Vz (mL/kg) | Half-life (day) | ADA |
|---|---|---|---|---|---|---|
| 186 | 1 | 3 | 13.3 ± 3.62 | 89.5 ± 23.6 | 4.72 ± 0.184 | 2 |
| 187 | 1$^a$ | 3 | 12.0 ± 2.82 | 87.9 ± 17.2 | 5.14 ± 0.871 | 1 |
| 180 | 1 | 3 | 14.4 ± 0.508 | 162 ± 18.5 | 7.80 ± 0.718 | 2 |
| 182 | 1 | 3 | 24.8 ± 4.22* | 162 ± 54.5* | 4.78 ± 2.35* | 3 |
| 185 | 1 | 3 | 17.0 ± 3.49* | 99.3 ± 23.1* | 4.03 ± 0.148* | 3 |

$^a$Dosed on day 0 and day 14
*PK analysis impacted by evidence of ADA

Example 14

Expression Vector Organization for the Production of Asymmetrical Bispecific Molecules Having Three Polypeptide Chains Bispecific molecule having anti-HIV gp120 Fab and anti-CD3 scFv. A bispecific molecule binding to CD3 and HIV gp120 and having three polypeptide chains, namely a heavy chain (HC) and a light chain (LC) of a Fab that binds to gp120 and a single-chain variable fragment (scFv) that binds to CD3, as described herein, was expressed from a single tricistronic plasmid vector (including two additional cistrons for expressing a eukaryotic selection marker and a prokaryotic selection marker). The expression of each polypeptide was driven by its own promotor, each promoter of equal transcription strength (e.g., a cytomegalovirus (CMV) promoter). The vector organization is illustrated in FIG. 34. The cistrons or expression cassettes are arranged 5' to 3' from the replication origin as: (1) a prokaryotic selection marker translated on the reverse or negative strand; and translated on the forward or positive strand (2) a eukaryotic selection marker (e.g., glutamine synthetase (GS); (3) a Fab light chain; (4) a Fab heavy chain; and (5) an scFv-Fc fusion protein. The expression vector was introduced into a Chinese Hamster Ovary (CHO) mammalian cell line, where the endogenous glutamine synthetase (GS) gene was eliminated. Expression of glutamine synthetase from the introduced vector was utilized as a selection marker when culturing the cells using the media without L-glutamine. The expression of bispecific molecules was measured by Protein A (ProA) Biosensors, while the desired format (i.e., assembly of the Fab heavy and light chains and the scFv-Fc fusion protein) of bispecific molecules was further selected using size separation. As shown in FIG. 35, various clones were propagated for 30 days (aged population, D30) and fed-batch production expression performance was evaluated and compared with the parental clones (D0). The results demonstrate that this platform enabled stable and high expression (specific titer >1 g/L, as calculated by the amount of total bispecific molecule detected via ProA Biosensors and then multiplied by the heterotrimer %) of this molecule.

Bispecific molecule having anti-CD3 Fab and CD4 extracellular (EC) domain-Fc fusion protein. A bispecific molecule binding to CD3 and HIV gp120 and having three polypeptide chains, namely a heavy chain (HC) and a light chain (LC) of a Fab that binds to CD3 and a CD4 extracellular domain-Fc fusion protein, described herein, was expressed from a single tricistronic plasmid vector (including two additional cistrons for expressing a eukaryotic selection marker and a prokaryotic selection marker). The expression of each polypeptide was driven by its own promotor, each promoter of equal transcription strength (e.g., a CMV promoter). The vector organization is illustrated in FIG. 36. The cistrons or expression cassettes are arranged 5' to 3' from the replication origin as: (1) a prokaryotic selection marker translated on the reverse or negative strand; and translated on the forward or positive strand (2) a eukaryotic selection marker (e.g., GS; (3) a Fab light chain; (4) a Fab heavy chain; and (5) a CD4 EC domain-Fc fusion protein. The expression vector was introduced into a CHO mammalian cell line, where the endogenous GS gene was eliminated. Expression of glutamine synthetase from the introduced vector was utilized as a selection marker when culturing the cells using the media without L-glutamine. The expression of bispecific molecules was measured by ProA Biosensors, while the desired format (i.e., assembly of the Fab heavy and light chains and the CD4 EC-Fc fusion protein) of bispecific molecules was further selected using size separation. As shown in FIG. 37, various clones were evaluated, and the results demonstrate high expression (specific titer >1 g/L) of this molecule.

Example 15

Bispecific Antibody and TLR7 Agonist Combination can Prevent Viral Rebound in Chronically SHIV-Infected Monkeys Viral replication can be efficiently suppressed by ART in HIV-1 infected individuals, however, a viral reservoir in latently infected CD4+ T lymphocytes is formed very early during infection (Colb, et al., *Nat Med* (2018) 24(7):923-6; Finzi, et al., *Science* (1997) 278(5341):1295-300; Siliciano, et al., *Nat Med* (2003) 9(6):727-8; and Wong, et al., *Science* (1997) 278(5341):1291-5). This viral reservoir represents a challenge for the development of a cure to HIV-1 and various strategies to target the viral reservoir are being investigated including pairing anti-HIV antibodies and immune modulators (Barouch, et al., *Science* (2014) 345 (6193):169-74; Deeks, et al., *Nat Med* 2016; 22 (8):839-50). A combination of vesatolimod (VES) and the HIV-1 bNAb PGT121 has been shown to delay or prevent viral rebound in SHIV-infected rhesus macaques following ART discontinuation {Borducchi, et al., Nature (2018) 563(7731):360-4; Tsa, et al., J Virol (2017) 91(8):e02166-16; and Walker, et al., Nature (2011) 477 (7365):466-70).

A bispecific PGT121/anti-CD3 generated in the DUO-BODY® platform (Labrijn, et al., Proc Natl Acad Sci USA. (2013) 110(13):5145-50) that contained a PGT121 Fv (for SHIV envelope recognition), an anti-CD3 Fv (for T-cell effector cell recruitment) and a rhesus Fc domain was dosed in combination with VES in SHIV-infected rhesus macaques (Macaca mulatta) on ART. Prior to dosing, the rhesus macaques were infected for 1 year followed by 2.5 years of ART. Animals received 2 biweekly doses of a CD3-inactive bispecific PGT121/anti-CD3KO (intravenous infusions of 5 mg/kg) followed by 10 biweekly doses of bispecific PGT121/anti-CD3 (intravenous infusions of 5 mg/kg). VES (oral administrations of 0.15 mg/kg) was given simultaneously for 10 doses with the first administration on the day of the first bispecific PGT121/anti-CD3 administration. The bispecific PGT121/anti-CD3KO was included to tolerize the animals to the bispecific antibody as previously described (Somerfield, et al., J Immunol (2010) July 1; 185(1):763-8). A sham group (saline placebo administrations) of 7 ART suppressed SHIV-infected rhesus macaques was included as controls.

Despite the administration of the bispecific PGT121/anti-CD3KO antibody, animals developed extensive anti-drug antibodies (ADAs) during the planned dosing period. Due to loss of exposure dosing was prematurely halted in three animals after the fourth, fifth and sixth dose of the bispecific PGT121/anti-CD3 antibody. Prior to the emergence of ADA, antibody serum concentrations had reached between 70 and 180 µg/mL 30 minutes post dosing and declined to between 1.7 and 11 µg/mL two weeks post dosing (FIG. 38). Two weeks following the last bispecific PGT121/anti-CD3 dose, all animals had serum concentrations below 1 µg/mL except one animal with a serum concentration of 2.3 µg/mL.

Twenty weeks after the final antibody dosing, ART was discontinued and animals were monitored for 24 weeks (168 days) to assess for viral rebound (FIG. 39). In the sham group, 7 of 7 animals rebounded and remained viremic in the 24 weeks monitoring. In contrast, in the bispecific-PGT121/anti-CD3/VES group, 1 of 9 animals did not rebound and three animals that initially rebounded re-suppressed. CD8+ T and NK cell depletion (intravenous infusion of an anti-CD8a CDR-grafted rhesus IgG1 antibody) did not identify any residual replication competent virus as the bispecific-PGT121/anti-CD3/VES treated animal that did not rebound following ART discontinuation remained aviremic (FIG. 40). In contrast, CD8+ T and NK cell depletion in 4 of the animals that rebounded following ART discontinuation resulted in plasma virus spikes in all animals, including 3 animals that were aviremic at the time of depletion demonstrating that in these animals, viral control was CD8+ T or NK cell mediated (FIG. 40).

The results are consistent with the conclusion that treatment of SHIV infected animals initiating ART during chronic infection with a bispecific-PGT121/anti-CD3 antibody in combination with the immune modulator VES resulted in suppression of viral rebound and/or virus control in a subset of animals following discontinuation of ART.

TABLE 53

Summary of Bispecific CD3 × gp120 Antigen Binding Molecules

| Bispecific Name | Features | SEQ ID NO: unpaired HC | SEQ ID NO: Fab arm - HC | SEQ ID NO: Fab arm - LC |
|---|---|---|---|---|
| 180 | hCD4 D1.22 Fc AAS + W + YTE/huSP34.39.13 AAS + SAV + R | 751 | 752 | 753 |
| 181 | hCD4 D1.22 Fc AAS + W/huSP34.39.13 AAS + SAV + R | 754 | 752 | 753 |
| 182 | hCD4 D1.22 Fc AAS + SAV + R/huSP34.3.13 AAS + W + YTE | 755 | 756 | 753 |
| 183 | hCD4 D1.22 Fc AAS + SAV + R/huSP34.3.13 AAS + W | 755 | 757 | 753 |
| 184 | hCD4 D1.22 Fc AAS + SAV/huSP34.3.13 AAS + W | 758 | 757 | 753 |
| 185 | hCD4 D1.22 Fc AAS + SAV + YTE/huSP34.3.13 AAS + W + YTE | 759 | 756 | 753 |
| 186 | hCD4 D1.22 Fc AAS + W/huSP34.1.3 AAS + SAV + R | 754 | 760 | 761 |
| 187 | hCD4 D1.22 Fc AAS + W + LS/huSP34.1.3 AAS + SAV + R | 762 | 760 | 761 |
| 188 | hCD4 D1.22 Fc AAS + W + YTE/huSP34.40.13 AAS + SAV + R | 751 | 763 | 753 |
| 189 | hCD4 D1.22 Fc AAS + W + YTE/huSP34.41.13 AAS + SAV + R | 751 | 901 | 753 |
| 190 | hCD4 D1.22(tandem) Fc AAS + W + YTE/huSP34.39.13 AAS + SAV + R | 764 | 752 | 753 |
| 191 | hCD4 D1.22(tandem) Fc AAS + W/huSP34.39.13 AAS + SAV + R | 765 | 752 | 753 |
| 192 | hCD4 D1.22(tandem) Fc AAS + SAV + R/huSP34.3.13 AAS + W + YTE | 766 | 767 | 753 |
| 193 | hCD4 D1.22(tandem) Fc AAS + SAV + R/huSP34.3.13 AAS + W | 766 | 768 | 753 |
| 194 | hCD4 D1.22(tandem) Fc AAS + SAV/huSP34.3.13 AAS + W | 769 | 768 | 753 |
| 195 | hCD4 D1.22(tandem) Fc AAS + SAV + YTE/huSP34.3.13 AAS + W + YTE | 770 | 767 | 753 |
| 196 | hCD4 D1.22(tandem) Fc AAS + W/huSP34.1.3 + SAV + R | 765 | 771 | 761 |
| 197 | hCD4 D1.22(tandem) Fc AAS + W + LS/huSP34.1.3 AAS + SAV + R | 772 | 771 | 761 |
| 198 | hCD4-D1.22(tandem) Fc AAS + W + LS/huSP34.1.3scFv AAS + SAV + R | 772 | 773 | |
| 199 | hCD4 D1.2(bivalent) AAS + W + LS/huSP34.1.3scFv AAS + SAV + R | 774 | 775 | 776 |
| 200 | hCD4 D1.22(bivalent) AAS + SAV + R/huSP34.3.13scFv AAS + W + YTE | 777 | 778 | 776 |
| 201 | hCD4 D1.22(bivalent) AAS + SAV + R/huSP34.3.13scFv AAS + W | 779 | 778 | 776 |
| 202 | hCD4 D1.22(bivalent) AAS + SAV/huSP34.3.13scFv AAS + W | 779 | 780 | 776 |
| 203 | hCD4 D1.22(bivalent) AAS + SAV + YTE/huSP34.3.13scFv AAS + W + YTE | 777 | 781 | 776 |
| 204 | hCD4 D1D2 Fc AAS + W + YTE/huSP34.39.13 AAS + SAV + R | 782 | 752 | 753 |
| 205 | hCD4 D1D2 Fc AAS + W/huSP34.39.13 AAS + SAV + R | 783 | 752 | 753 |
| 206 | hCD4 D1D2 Fc AAS + SAV + R/huSP34.3.13 AAS + W + YTE | 784 | 785 | 753 |
| 207 | hCD4 D1D2 Fc AAS + SAV + R/huSP34.3.13 AAS + W | 784 | 786 | 753 |
| 208 | hCD4 D1D2 Fc AAS + SAV/huSP34.3.13 AAS + W | 787 | 786 | 753 |
| 209 | hCD4 D1D2 Fc AAS + SAV + YTE/huSP34.3.13 AAS + W + YTE | 788 | 785 | 753 |

TABLE 53-continued

Summary of Bispecific CD3 × gp120 Antigen Binding Molecules

| Bispecific Name | Features | SEQ ID NO: unpaired HC | SEQ ID NO: Fab arm - HC | SEQ ID NO: Fab arm - LC |
|---|---|---|---|---|
| 210 | hCD4 D1D2 Fc AAS + W/huSP34.1.3 AAS + SAV + R | 783 | 789 | 761 |
| 211 | hCD4-D1D2 Fc AAS + W + LS/huSP34.1.3 AAS + SAV + R | 790 | 789 | 761 |
| 212 | hCD4-D1D2 Fc AAS + W + LS/huSP34.1.3scFv AAS + SAV + R | 790 | 791 | |
| 213 | hCD4-D1D2(bivalent) AAS + W + LS/huSP34.1.3scFv AAS + SAV + R | 792 | 793 | 794 |
| 214 | hCD4-D1D2(bivalent) AAS + SAV + R/huSP34.3.13scFv AAS + W + YTE | 795 | 796 | 794 |
| 215 | hCD4-D1D2(bivalent) AAS + SAV + R/huSP34.3.13scFv AAS + W | 797 | 796 | 794 |
| 216 | hCD4-D1D2(bivalent) AAS + SAV/huSP34.3.13scFv AAS + W | 797 | 798 | 794 |
| 217 | hCD4-D1D2(bivalent) AAS + SAV + YTE/huSP34.3.13scFv AAS + W + YTE | 795 | 799 | 794 |
| 218 | h3BNC117.52.64 AAS + SAV + YTE/huSP34.3.13 scFv AAS + W + YTE | 800 | 801 | 802 |
| 219 | h3BNC117.52.64 AAS + SAV + R/huSP34.3.13scFv AAS + W + YTE | 800 | 803 | 802 |
| 220 | h3BNC117.52.64 AAS + SAV + R/huSP34.3.13scFv AAS + W | 804 | 803 | 802 |
| 221 | h3BNC117.52.64 AAS + SAV/huSP34.3.13scFv AAS + W | 804 | 805 | 802 |
| 222 | h3BNC117.52.64 AAS + SAV + YTE/huSP34.39.13 scFv AAS + W + YTE | 806 | 801 | 802 |
| 223 | h3BNC117.52.64 AAS + SAV + R/huSP34.39.13scFv AAS + W + YTE | 806 | 803 | 802 |
| 224 | h3BNC117.52.64 AAS + SAV + R/huSP34.39.13scFv AAS + W | 807 | 803 | 802 |
| 225 | h3BNC117.52.64 AAS + SAV/huSP34.39.13scFv AAS + W | 807 | 805 | 802 |
| 226 | h3BNC117.52.64 AAS + W + YTE/huSP34.39.13scFv AAS + SAV + R | 808 | 809 | 802 |
| 227 | h3BNC117.52.64 AAS + W/huSP34.39.13scFv AAS + SAV + R | 808 | 810 | 802 |
| 228 | h3BNC117.52.64 AAS + SAV + YTE/huSP34.1.3scFv AAS + W + YTE | 811 | 801 | 802 |
| 229 | h3BNC117.52.64 AAS + W + YTE/huSP34.1.3 scFv AAS + SAV + R | 812 | 809 | 802 |
| 230 | h3BNC117.52.64 AAS + W/huSP34.1.3scFv AAS + SAV + R | 812 | 810 | 802 |
| 231 | h3BNC117.52.64 AAS + SAV/huSP34.1.3scFv AAS + W | 813 | 805 | 802 |
| 232 | h3BNC117.52.64 AAS + W + LS/huSP34.1.3 scFv AAS + SAV + R | 812 | 814 | 802 |
| 233 | h3BNC117.52.64 AAS + SAV + YTE/huSP34.3.8scFv AAS + W + YTE | 815 | 801 | 802 |
| 234 | h3BNC117.52.64 AAS + SAV/huSP34.3.8scFv AAS + W | 816 | 805 | 802 |
| 235 | h3BNC117.52.64 AAS + SAV + YTE/huSP34.34.3scFv AAS + W + YTE | 817 | 801 | 802 |
| 236 | h3BNC117.52.64 AAS + SAV/huSP34.34.3scFv AAS + W | 818 | 805 | 802 |
| 237 | h3BNC117.52.64 AAS + W/huSP34.13.8scFv AAS + SAV + R | 819 | 810 | 802 |
| 238 | h3BNC117.52.64 AAS + W/huSP34.4.2scFv AAS + SAV + R | 820 | 810 | 802 |
| 239 | hPGT121.66 AAS + SAV + YTE/huSP34.3.13scFv AAS + W + YTE | 821 | 822 | 823 |
| 240 | hPGT121.66 AAS + SAV + R/huSP34.3.13scFv AAS + W + YTE | 824 | 825 | 823 |
| 241 | hPGT121.66 AAS + SAV + R/huSP34.3.13scFv AAS + W | 826 | 825 | 823 |
| 242 | hPGT121.66 AAS + SAV/huSP34.3.13scFv AAS + W | 826 | 827 | 823 |
| 243 | hPGT121.66 AAS + W/huSP34.3.13scFv AAS + SAV + R | 828 | 829 | 823 |
| 244 | hPGT121.66 AAS + SAV + YTE/huSP34.39.13scFv AAS + W + YTE | 830 | 822 | 823 |
| 245 | hPGT121.66 AAS + SAV + R/huSP34.39.13scFv AAS + W + YTE | 830 | 825 | 823 |
| 246 | hPGT121.66 AAS + SAV + R/huSP34.39.13scFv AAS + W | 831 | 825 | 823 |
| 247 | hPGT121.66 AAS + SAV/huSP34.39.13scFv AAS + W | 831 | 827 | 823 |
| 248 | hPGT121.66 AAS + W + YTE/huSP34.39.13scFv AAS + SAV + R | 832 | 833 | 823 |
| 249 | hPGT121.66 AAS W/huSP34.39.13 scFv AAS + SAV + R | 832 | 829 | 823 |
| 250 | hPGT121.66 AAS + SAV/huSP34.1.3 scFv AAS + W | 834 | 827 | 823 |
| 251 | hPGT121.66 AAS + W/huSP34.1.3 scFv AAS + SAV + RF | 835 | 829 | 823 |
| 252 | hPGT121.66 AAS + W/huSP34.1.3 scFv AAS + SAV + R | 836 | 829 | 823 |
| 253 | hPGT121.66 AAS + W + YTE/huSP34.1.3 scFv AAS + SAV + R | 837 | 833 | 823 |
| 254 | hPGT121.66 AAS + W + LS/huSP34.1.3 scFv AAS + SAV + R | 837 | 838 | 823 |
| 255 | hPGT121.66 W/huSP34.1.3scFv SAV + R | 839 | 840 | 823 |
| 256 | hPGT121.66 AAS + W/huSP34.3.8 scFv AAS + SAV + R | 841 | 829 | 823 |
| 257 | hPGT121.66 AAS + W/huSP34.34.3 scFv AAS + SAV + R | 842 | 829 | 823 |
| 258 | hPGT121.66 AAS + W/huSP34.3.4 scFv AAS + SAV + RF | 843 | 829 | 823 |
| 259 | hPGT121.66 AAS + W/huSP34.3.6scFv AAS + SAV + RF | 844 | 829 | 823 |
| 260 | hPGT121.66 AAS + W/huSP34.8.3 scFv AAS + SAV + RF | 845 | 829 | 823 |
| 261 | hPGT121.66 AAS + W/huSP34.13.8 scFv AAS + SAV + R | 846 | 829 | 823 |
| 262 | hPGT121.66 AAS + W + YTE/huSP34.13.8 scFv AAS + SAV + R | 846 | 833 | 823 |
| 263 | hPGT121.66 AAS + W + LS/huSP34.13.8 scFv AAS + SAV + R | 846 | 838 | 823 |
| 264 | hPGT121.66 AAS + SAV/huSP34.13.10scFv AAS + W | 847 | 827 | 823 |
| 265 | hPGT121.66 AAS + W/huSP34.13.10 scFv AAS + SAV + RF | 848 | 829 | 823 |
| 266 | hPGT121.66 AAS + W/huSP34.14.8scFv AAS + SAV + R | 849 | 829 | 823 |
| 267 | hPGT121.66 AAS + W/huSP34.19.8scFv AAS + SAV + R | 850 | 829 | 823 |
| 268 | hPGT121.66 AAS + W/huSP34.25.8scFv AAS + SAV + R | 851 | 829 | 823 |

TABLE 53-continued

Summary of Bispecific CD3 × gp120 Antigen Binding Molecules

| Bispecific Name | Features | SEQ ID NO: unpaired HC | SEQ ID NO: Fab arm - HC | SEQ ID NO: Fab arm - LC |
|---|---|---|---|---|
| 269 | hPGT121.66 AAS + W/huSP34.26.8scFv AAS + SAV + R | 852 | 829 | 823 |
| 270 | hPGT121.66 AAS + W/huSP34.27.8 scFv AAS + SAV + R | 853 | 829 | 823 |
| 271 | hPGT121.66 AAS + W/huSP34.28.8scFv AAS + SAV + R | 854 | 829 | 823 |
| 272 | hPGT121.66 AAS + W/huSP34.33.8 scFv AAS + SAV + R | 855 | 829 | 823 |
| 273 | hPGT121.66 AAS + W/huSP34.34.10 scFv AAS + SAV + R | 856 | 829 | 823 |
| 274 | hPGT121.66 AAS + W/huSP34.34.11 scFv AAS + SAV + R | 857 | 829 | 823 |
| 275 | hPGT121.66 AAS + W/huSP34.34.12scFv AAS + SAV + R | 858 | 829 | 823 |
| 276 | hPGT121.66 AAS + W/huSP34.40.13 scFv AAS + SAV + R | 859 | 829 | 823 |
| 277 | hPGT121.66 AAS + W/huSP34.41.13 scFv AAS + SAV + R | 860 | 829 | 823 |
| 278 | 10-1074 AAS + SAV + YTE/huSP34.3.13scFv AAS + W + YTE | 861 | 862 | 863 |
| 279 | 10-1074 AAS + SAV + R/huSP34.3.13scFv AAS + W + YTE | 861 | 864 | 863 |
| 280 | 10-1074 AAS + SAV + R/huSP34.3.13scFv AAS + W | 865 | 864 | 863 |
| 281 | 10-1074 AAS + SAV/huSP34.3.13scFv AAS + W | 865 | 866 | 863 |
| 282 | 10-1074 AAS + W/huSP34.3.13scFv AAS + SAV + R | 867 | 868 | 863 |
| 283 | 10-1074 AAS + SAV + YTE/huSP34.39.13scFv AAS + W + YTE | 869 | 862 | 863 |
| 284 | 10-1074 AAS + SAV + R/huSP34.39.13scFv AAS + W + YTE | 869 | 864 | 863 |
| 285 | 10-1074 AAS + SAV + R/huSP34.39.13scFv AAS + W | 870 | 864 | 863 |
| 286 | 10-1074 AAS + SAV/huSP34.39.13scFv AAS + W | 870 | 866 | 863 |
| 287 | 10-1074 AAS + W + YTE/huSP34.39.13scFv AAS + SAV + R | 871 | 872 | 863 |
| 288 | 10-1074 AAS + W/huSP34.39.13scFv AAS + SAV + R | 871 | 868 | 863 |
| 289 | 10-1074 AAS + SAV + YTE/huSP34.1.3scFv AAS + W + YTE | 873 | 862 | 863 |
| 290 | 10-1074 AAS + SAV/huSP34.1.3scFv AAS + W | 874 | 866 | 863 |
| 291 | 10-1074 AAS + W + YTE/huSP34.1.3 scFv AAS + SAV + R | 875 | 872 | 863 |
| 292 | 10-1074 AAS + W/huSP34.1.3scFv AAS + SAV + R | 875 | 868 | 863 |
| 293 | 10-1074 AAS + W + LS/huSP34.1.3 scFv AAS + SAV + R | 875 | 876 | 863 |
| 294 | 10-1074 AAS + SAV + YTE/huSP34.3.8scFv AAS + W + YTE | 877 | 862 | 863 |
| 295 | 10-1074 AAS + SAV/huSP34.3.8scFv AAS + W | 878 | 866 | 863 |
| 296 | 10-1074 AAS + SAV + YTE/huSP34.34.3scFv AAS + W + YTE | 879 | 862 | 863 |
| 297 | 10-1074 AAS + SAV/huSP34.34.3scFv AAS + W | 880 | 866 | 863 |
| 298 | PGT-134 AAS + SAV + YTE/huSP34.3.13scFv AAS + W + YTE | 881 | 882 | 883 |
| 299 | PGT-134 AAS + SAV + R/huSP34.3.13scFv AAS + W + YTE | 881 | 884 | 883 |
| 300 | PGT-134 AAS + SAV + R/huSP34.3.13scFv AAS + W | 885 | 884 | 883 |
| 301 | PGT-134 AAS + SAV/huSP34.3.13scFv AAS + W | 885 | 886 | 883 |
| 302 | PGT-134 AAS + W/huSP34.3.13scFv AAS + SAV + R | 887 | 888 | 883 |
| 303 | PGT-134 AAS + SAV + YTE/huSP34.39.13scFv AAS + W + YTE | 889 | 882 | 883 |
| 304 | PGT-134 AAS + SAV + R/huSP34.39.13scFv AAS + W + YTE | 889 | 884 | 883 |
| 305 | PGT-134 AAS + SAV + R/huSP34.39.13scFv AAS + W | 890 | 884 | 883 |
| 306 | PGT-134 AAS + SAV/huSP34.39.13scFv AAS + W | 890 | 886 | 883 |
| 307 | PGT-134 AAS + W + YTE/huSP34.39.13scFv AAS + SAV + R | 891 | 892 | 883 |
| 308 | PGT-134 AAS + W/huSP34.39.13scFv AAS + SAV + R | 891 | 888 | 883 |
| 309 | PGT-134 AAS + SAV + YTE/huSP34.1.3scFv AAS + W + YTE | 893 | 882 | 883 |
| 310 | PGT-134 AAS + SAV/huSP34.1.3scFv AAS + W | 894 | 886 | 883 |
| 311 | PGT-134 AAS + W + YTE/huSP34.1.3 scFv AAS + SAV + R | 895 | 892 | 883 |
| 312 | PGT-134 AAS + W/huSP34.1.3scFv AAS + SAV + R | 895 | 888 | 883 |
| 313 | PGT-134 AAS + W + LS/huSP34.1.3 scFv AAS + SAV + R | 895 | 896 | 883 |
| 314 | PGT-134 AAS + SAV + YTE/huSP34.3.8scFv AAS + W + YTE | 897 | 882 | 883 |
| 315 | PGT-134 AAS + SAV/huSP34.3.8scFv AAS + W | 898 | 886 | 883 |
| 316 | PGT-134 AAS + SAV + YTE/huSP34.34.3scFv AAS + W + YTE | 899 | 882 | 883 |
| 317 | PGT-134 AAS + SAV/huSP34.34.3scFv AAS + W | 900 | 886 | 883 |

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (1093 sequences)

SEQ ID NO: 1 - protein, 5 aa, Artificial Sequence
  Description of Artificial Sequence: Synthetic peptide
TYAMN

SEQ ID NO: 2 - protein, 19 aa, Artificial Sequence
  Description of Artificial Sequence: Synthetic peptide
  MOD_RES (15)..(15): A or D
  MOD_RES (19)..(19): G or S
RIRSKYNNYATYYAXSVKX

SEQ ID NO: 3 - protein, 14 aa, Artificial Sequence
  Description of Artificial Sequence: Synthetic peptide
  MOD_RES (6)..(6): H or N
HGNFGXSYVSWFAY

SEQ ID NO: 4 - protein, 14 aa, Artificial Sequence
  Description of Artificial Sequence: Synthetic peptide
GSSTGAVTTGHYAN

SEQ ID NO: 5 - protein, 7 aa, Artificial Sequence
  Description of Artificial Sequence: Synthetic peptide
  MOD_RES (3)..(4): This region may encompass "SN" or "NK"
GTXXRAP

SEQ ID NO: 6 - protein, 9 aa, Artificial Sequence
  Description of Artificial Sequence: Synthetic peptide
  MOD_RES (7)..(7): L or R
ALWYSNXWV

SEQ ID NO: 7 - protein, 19 aa, Artificial Sequence
  Description of Artificial Sequence: Synthetic peptide
  MOD_RES (19)..(19): G or S
RIRSKYNNYATYYADSVKX

SEQ ID NO: 8 - protein, 14 aa, Artificial Sequence
  Description of Artificial Sequence: Synthetic peptide
HGNFGHSYVSWFAY

SEQ ID NO: 9 - protein, 7 aa, Artificial Sequence
  Description of Artificial Sequence: Synthetic peptide
GTSNRAP

SEQ ID NO: 10 - protein, 9 aa, Artificial Sequence
  Description of Artificial Sequence: Synthetic peptide
ALWYSNRWV

SEQ ID NO: 11 - protein, 19 aa, Artificial Sequence
  Description of Artificial Sequence: Synthetic peptide
RIRSKYNNYATYYADSVKG

SEQ ID NO: 12 - protein, 19 aa, Artificial Sequence
  Description of Artificial Sequence: Synthetic peptide
RIRSKYNNYATYYADSVKS

SEQ ID NO: 13 - protein, 19 aa, Artificial Sequence
  Description of Artificial Sequence: Synthetic peptide
RIRSKYNNYATYYAASVKG

SEQ ID NO: 14 - protein, 7 aa, Artificial Sequence
  Description of Artificial Sequence: Synthetic peptide
GTNKRAP

SEQ ID NO: 15 - protein, 9 aa, Artificial Sequence
  Description of Artificial Sequence: Synthetic peptide
ALWYSNLWV

SEQ ID NO: 16 - protein, 14 aa, Artificial Sequence
  Description of Artificial Sequence: Synthetic peptide
HGNFGNSYVSWFAY

SEQ ID NO: 17 - protein, 7 aa, Artificial Sequence
  Description of Artificial Sequence: Synthetic peptide
GFTFNTY

SEQ ID NO: 18 - protein, 6 aa, Artificial Sequence
  Description of Artificial Sequence: Synthetic peptide
SKYNNY

SEQ ID NO: 19 - protein, 12 aa, Artificial Sequence
  Description of Artificial Sequence: Synthetic peptide
  MOD_RES (5)..(5): H or N
GNFGXSYVSWFA

SEQ ID NO: 20 - protein, 11 aa, Artificial Sequence
  Description of Artificial Sequence: Synthetic peptide
SSTGAVTTGHY

SEQ ID NO: 21 - protein, 3 aa, Artificial Sequence
  Description of Artificial Sequence: Synthetic peptide
  MOD_RES (3)..(3): N or S
GTX

SEQ ID NO: 22 - protein, 6 aa, Artificial Sequence
  Description of Artificial Sequence: Synthetic peptide
  MOD_RES (5)..(5): L or R
WYSNXW

SEQ ID NO: 23 - protein, 12 aa, Artificial Sequence
  Description of Artificial Sequence: Synthetic peptide
GNFGHSYVSWFA

SEQ ID NO: 24 - protein, 3 aa, Artificial Sequence
  Description of Artificial Sequence: Synthetic peptide
GTS

SEQ ID NO: 25 - protein, 6 aa, Artificial Sequence
  Description of Artificial Sequence: Synthetic peptide
WYSNRW

SEQ ID NO: 26 - protein, 3 aa, Artificial Sequence
  Description of Artificial Sequence: Synthetic peptide
GTN

SEQ ID NO: 27 - protein, 6 aa, Artificial Sequence
  Description of Artificial Sequence: Synthetic peptide
WYSNLW

SEQ ID NO: 28 - protein, 8 aa, Artificial Sequence
  Description of Artificial Sequence: Synthetic peptide
GFTFNTYA

SEQ ID NO: 29 - protein, 10 aa, Artificial Sequence
  Description of Artificial Sequence: Synthetic peptide
IRSKYNNYAT

SEQ ID NO: 30 - protein, 16 aa, Artificial Sequence
  Description of Artificial Sequence: Synthetic peptide
  MOD_RES (8)..(8): H or N
VRHGNFGXSYVSWFAY

SEQ ID NO: 31 - protein, 9 aa, Artificial Sequence
  Description of Artificial Sequence: Synthetic peptide
TGAVTTGHY

SEQ ID NO: 32 - protein, 16 aa, Artificial Sequence
  Description of Artificial Sequence: Synthetic peptide
VRHGNFGHSYVSWFAY

SEQ ID NO: 33 - protein, 16 aa, Artificial Sequence
  Description of Artificial Sequence: Synthetic peptide
VRHGNFGNSYVSWFAY

SEQ ID NO: 34 - protein, 10 aa, Artificial Sequence
  Description of Artificial Sequence: Synthetic peptide
ASGFTFNTYA

SEQ ID NO: 35 - protein, 19 aa, Artificial Sequence
  Description of Artificial Sequence: Synthetic peptide
  MOD_RES (14)..(14): A or D
  MOD_RES (18)..(18): G or S
IRSKYNNYATYYAXSVKXR

SEQ ID NO: 36 - protein, 13 aa, Artificial Sequence
  Description of Artificial Sequence: Synthetic peptide
  MOD_RES (6)..(6): H or N
HGNFGXSYVSWFA

SEQ ID NO: 37 - protein, 11 aa, Artificial Sequence
  Description of Artificial Sequence: Synthetic peptide
SSTGAVTTGHY

SEQ ID NO: 38 - protein, 12 aa, Artificial Sequence
  Description of Artificial Sequence: Synthetic peptide
  MOD_RES (3)..(3): N or S
  MOD_RES (8)..(8): G or W
GTXNRAPXVPAR

SEQ ID NO: 39 - protein, 19 aa, Artificial Sequence
  Description of Artificial Sequence: Synthetic peptide
  MOD_RES (18)..(18): G or S
IRSKYNNYATYYADSVKXR

SEQ ID NO: 40 - protein, 13 aa, Artificial Sequence
  Description of Artificial Sequence: Synthetic peptide
HGNFGHSYVSWFA

SEQ ID NO: 41 - protein, 12 aa, Artificial Sequence
  Description of Artificial Sequence: Synthetic peptide
GTSNRAPGVPAR

SEQ ID NO: 42 - protein, 19 aa, Artificial Sequence
  Description of Artificial Sequence: Synthetic peptide
IRSKYNNYATYYADSVKGR

SEQ ID NO: 43 - protein, 19 aa, Artificial Sequence
  Description of Artificial Sequence: Synthetic peptide
IRSKYNNYATYYADSVKSR

SEQ ID NO: 44 - protein, 19 aa, Artificial Sequence
  Description of Artificial Sequence: Synthetic peptide
IRSKYNNYATYYAASVKGR

SEQ ID NO: 45 - protein, 12 aa, Artificial Sequence
  Description of Artificial Sequence: Synthetic peptide
GTNKRAPWTPAR

SEQ ID NO: 46 - protein, 13 aa, Artificial Sequence
  Description of Artificial Sequence: Synthetic peptide
HGNFGNSYVSWFA

SEQ ID NO: 47 - protein, 12 aa, Artificial Sequence
  Description of Artificial Sequence: Synthetic peptide
GTNKRAPGVPAR

SEQ ID NO: 48 - protein, 125 aa, Artificial Sequence
  Description of Artificial Sequence: Synthetic polypeptide
  MOD_RES (64)..(64): A or D
  MOD_RES (68)..(68): G or S
  MOD_RES (84)..(84): E or Q
  MOD_RES (89)..(89): K or R
  MOD_RES (95)..(95): M or V
  MOD_RES (106)..(106): H or N
EVQLVESGGGLVQPGGSLRLSCAASGFTFNTYAMNWVRQAPGKGLEWVGRIRSKYNNYATYYAXSVKXRFTISRDDSKNSLYLXMNSLXTEDTAXYYCVRHGNFGXSYVSWFAYWGQGTLVTVSS

SEQ ID NO: 49 - protein, 125 aa, Artificial Sequence
  Description of Artificial Sequence: Synthetic polypeptide
  MOD_RES (68)..(68): G or S
  MOD_RES (84)..(84): E or Q
EVQLVESGGGLVQPGGSLRLSCAASGFTFNTYAMNWVRQAPGKGLEWVGRIRSKYNNYATYYADSVKXRFTISRDDSKNSLYLXMNSLRTEDTAVYYCVRHGNFGHSYVSWFAYWGQGTLVTVSS

SEQ ID NO: 50 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSS

SEQ ID NO: 51 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSS

SEQ ID NO: 52 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSS

SEQ ID NO: 53 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSS

SEQ ID NO: 54 - protein, 109 aa, Artificial Sequence
  Description of Artificial Sequence: Synthetic polypeptide
  MOD_RES (54)..(55): This region may encompass "SN" or "NK"
  MOD_RES (59)..(59): G or W
  MOD_RES (77)..(77): I or L
  MOD_RES (97)..(97): L or R
QAVVTQEPSLTVSPGGTVTLTCGSSTGAVTTGHYANWVQQKPGQAPRGLIGGTXXRAPXVPARFSGSLLGGKAALTXSGAQPEDEAEYYCALWYSNXWVFGGGTKLTVL

SEQ ID NO: 55 - protein, 109 aa, Artificial Sequence
  Description of Artificial Sequence: Synthetic polypeptide
  MOD_RES (54)..(55): This region may encompass "SN" or "NK"
QAVVTQEPSLTVSPGGTVTLTCGSSTGAVTTGHYANWVQQKPGQAPRGLIGGTXXRAPGVPARFSGSLLGGKAALTISGAQPEDEAEYYCALWYSNRWVFGGGTKLTVL

SEQ ID NO: 56 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVL

SEQ ID NO: 57 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVL

SEQ ID NO: 58 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVL

SEQ ID NO: 59 - protein, 254 aa, Artificial Sequence
  Description of Artificial Sequence: Synthetic polypeptide
  MOD_RES (64)..(64): A or D
  MOD_RES (68)..(68): G or S
  MOD_RES (84)..(84): E or Q
  MOD_RES (89)..(89): K or R
  MOD_RES (95)..(95): M or V
  MOD_RES (106)..(106): H or N
  MOD_RES (199)..(200): This region may encompass "SN" or "NK"
  MOD_RES (204)..(204): G or W
  MOD_RES (222)..(222): I or L
  MOD_RES (242)..(242): L or R
EVQLVESGGGLVQPGGSLRLSCAASGFTFNTYAMNWVRQAPGKGLEWVGRIRSKYNNYATYYAXSVKXRFTISRDDSKNSLYLXMNSLXTEDTAXYYCVRHGNFGXSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTXXRAPXVPARFSGSLLGGKAALTXSGAQPEDEAEYYCALWYSNXWVFGGGTKLTVL

SEQ ID NO: 60 - protein, 254 aa, Artificial Sequence
  Description of Artificial Sequence: Synthetic polypeptide
  MOD_RES (68)..(68): G or S
  MOD_RES (84)..(84): E or Q
  MOD_RES (199)..(200): This region may encompass "SN" or "NK"
EVQLVESGGGLVQPGGSLRLSCAASGFTFNTYAMNWVRQAPGKGLEWVGRIRSKYNNYATYYADSVKXRFTISRDDSKNSLYLXMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTXXRAPGVPARFSGSLLGGKAALTISGAQPEDEAEYYCALWYSNRWVFGGGTKLTVL

SEQ ID NO: 61 - protein, 254 aa, Artificial Sequence
  Description of Artificial Sequence: Synthetic polypeptide
  MOD_RES (68)..(68): G or S
  MOD_RES (84)..(84): E or Q
EVQLVESGGGLVQPGGSLRLSCAASGFTFNTYAMNWVRQAPGKGLEWVGRIRSKYNNYATYYADSVKXRFTISRDDSKNSLYLXMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVL

SEQ ID NO: 62 - protein, 254 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVL

SEQ ID NO: 63 - protein, 254 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVL

SEQ ID NO: 64 - protein, 254 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVL

SEQ ID NO: 65 - protein, 254 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVL

SEQ ID NO: 66 - protein, 254 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVL

SEQ ID NO: 67 - protein, 849 aa, Human immunodeficiency virus 1
MKVMGTKKNYQHLWRWGIMLLGMLMMSSAAEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTSYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKRAVTLGAVFLGFLGAAGSTMGAASLTLTVQARLLLSGIVQQQSNLLRAIEAQQHMLQLTVWGIKQLQARVLAIERYLKDQQLLGIWGCSGKLICTTTVPWNTSWSNKSYDYIWNNMTWMQWEREIDNYTGFIYTLIEESQNQQEKNELELLELDKWASLWNWFNITNWLWYIKLFIMIIGGLVGLRIVCAVLSIVNRVRQGYSPLSFQTRLPNPRGPDRPEETEGEGGERDRDRSARLVNGFLAIIWDDLRSLCLFSYHRLRDLLLIVARVVEILGRRGWEILKYWWNLLKYWSQELKNSAVSLLNVTAIAVAEGTDRVIEIVQRAVRAILHIPTRIRQGFERALL

SEQ ID NO: 68 - protein, 856 aa, Human immunodeficiency virus 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 69 - protein, 511 aa, Human immunodeficiency virus 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKR

SEQ ID NO: 70 - protein, 475 aa, Human immunodeficiency virus 1
AEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTSYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKR

SEQ ID NO: 71 - protein, 481 aa, Human immunodeficiency virus 1
TEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKR

SEQ ID NO: 72 - protein, 35 aa, Human immunodeficiency virus 1
CTRPNNNTRKSIHIGPGRAFYTTGEIIGDIRQAHC

SEQ ID NO: 73 - protein, 511 aa, Human immunodeficiency virus 1; identical to SEQ ID NO: 69

SEQ ID NO: 74 - protein, 36 aa, Artificial Sequence
  Description of Artificial Sequence: Synthetic polypeptide
RVSLTRHASFDFDTFSFYMDLKALRSDDTAVYFCAR

SEQ ID NO: 75 - protein, 12 aa, Artificial Sequence
  Description of Artificial Sequence: Synthetic peptide
GNFGNSYVSWFA

SEQ ID NO: 76 - protein, 5 aa, Artificial Sequence
  Description of Artificial Sequence: Synthetic peptide
DSYWS

SEQ ID NO: 77 - protein, 16 aa, Artificial Sequence
  Description of Artificial Sequence: Synthetic peptide
YVHKSGDTNYSPSLKS

SEQ ID NO: 78 - protein, 24 aa, Artificial Sequence
  Description of Artificial Sequence: Synthetic peptide
TLHGRRIYGIVAFNEWFTYFYMDV

SEQ ID NO: 79 - protein, 11 aa, Artificial Sequence
  Description of Artificial Sequence: Synthetic peptide
GEKSLGSRAVQ

SEQ ID NO: 80 - protein, 7 aa, Artificial Sequence
  Description of Artificial Sequence: Synthetic peptide
NNQDRPS

SEQ ID NO: 81 - protein, 12 aa, Artificial Sequence
  Description of Artificial Sequence: Synthetic peptide
HIWDSRVPTKWV

SEQ ID NO: 82 - protein, 16 aa, Artificial Sequence
  Description of Artificial Sequence: Synthetic peptide
YVHKSGDTNYNPSLKS

SEQ ID NO: 83 - protein, 5 aa, Artificial Sequence
  Description of Artificial Sequence: Synthetic peptide
NYYWT

SEQ ID NO: 84 - protein, 16 aa, Artificial Sequence
  Description of Artificial Sequence: Synthetic peptide
YISDRESATYNPSLNS

SEQ ID NO: 85 - protein, 24 aa, Artificial Sequence
  Description of Artificial Sequence: Synthetic peptide
ARRGQRIYGVVSFGEFFYYYSMDV

SEQ ID NO: 86 - protein, 11 aa, Artificial Sequence
  Description of Artificial Sequence: Synthetic peptide
GRQALGSRAVQ

SEQ ID NO: 87 - protein, 12 aa, Artificial Sequence
  Description of Artificial Sequence: Synthetic peptide
HMWDSRSGFSWS

SEQ ID NO: 88 - protein, 16 aa, Artificial Sequence
  Description of Artificial Sequence: Synthetic peptide
YISDRETTTYNPSLNS

SEQ ID NO: 89 - protein, 24 aa, Artificial Sequence
  Description of Artificial Sequence: Synthetic peptide
ARRGQRIYGVVSFGEFFYYYYMDV

SEQ ID NO: 90 - protein, 5 aa, Artificial Sequence
  Description of Artificial Sequence: Synthetic peptide
GRFWS

SEQ ID NO: 91 - protein, 16 aa, Artificial Sequence
  Description of Artificial Sequence: Synthetic peptide
YFSDTDRSEYNPSLRS

SEQ ID NO: 92 - protein, 24 aa, Artificial Sequence
  Description of Artificial Sequence: Synthetic peptide
AQQGKRIYGIVSFGEFFYYYYMDA

SEQ ID NO: 93 - protein, 11 aa, Artificial Sequence
  Description of Artificial Sequence: Synthetic peptide
GERSRGSRAVQ

SEQ ID NO: 94 - protein, 7 aa, Artificial Sequence
  Description of Artificial Sequence: Synthetic peptide
NNQDRPA

SEQ ID NO: 95 - protein, 12 aa, Artificial Sequence
  Description of Artificial Sequence: Synthetic peptide
HYWDSRSPISWI

SEQ ID NO: 96 - protein, 24 aa, Artificial Sequence
  Description of Artificial Sequence: Synthetic peptide
AQQGKRIYGIVSFGELFYYYYMDA

SEQ ID NO: 97 - protein, 5 aa, Artificial Sequence
  Description of Artificial Sequence: Synthetic peptide
DNYWS

SEQ ID NO: 98 - protein, 16 aa, Artificial Sequence
  Description of Artificial Sequence: Synthetic peptide
YVHDSGDTNYNPSLKS

SEQ ID NO: 99 - protein, 24 aa, Artificial Sequence
  Description of Artificial Sequence: Synthetic peptide
TKHGRRIYGVVAFKEWFTYFYMDV

SEQ ID NO: 100 - protein, 11 aa, Artificial Sequence
  Description of Artificial Sequence: Synthetic peptide
GEESLGSRSVI

SEQ ID NO: 101 - protein, 7 aa, Artificial Sequence
  Description of Artificial Sequence: Synthetic peptide
NNNDRPS

SEQ ID NO: 102 - protein, 12 aa, Artificial Sequence
  Description of Artificial Sequence: Synthetic peptide
HIWDSRRPTNWV

SEQ ID NO: 103 - protein, 5 aa, Artificial Sequence
  Description of Artificial Sequence: Synthetic peptide
DAYWS

SEQ ID NO: 104 - protein, 16 aa, Artificial Sequence
  Description of Artificial Sequence: Synthetic peptide
YVHHSGDTNYNPSLKR

SEQ ID NO: 105 - protein, 24 aa, Artificial Sequence
  Description of Artificial Sequence: Synthetic peptide
ALHGKRIYGIVALGELFTYFYMDV

SEQ ID NO: 106 - protein, 11 aa, Artificial Sequence
  Description of Artificial Sequence: Synthetic peptide
GKESIGSRAVQ

SEQ ID NO: 107 - protein, 12 aa, Artificial Sequence
  Description of Artificial Sequence: Synthetic peptide
HIYDARGGTNWV

SEQ ID NO: 108 - protein, 7 aa, Artificial Sequence
  Description of Artificial Sequence: Synthetic peptide
ACTYFWG

SEQ ID NO: 109 - protein, 22 aa, Artificial Sequence
  Description of Artificial Sequence: Synthetic peptide
SLSHCQSFWGSGWTFHNPSLKS

SEQ ID NO: 110 - protein, 19 aa, Artificial Sequence
  Description of Artificial Sequence: Synthetic peptide
FDGEVLVYNHWPKPAWVDL

SEQ ID NO: 111 - protein, 9 aa, Artificial Sequence
  Description of Artificial Sequence: Synthetic peptide
NGTATNFVS

SEQ ID NO: 112 - protein, 7 aa, Artificial Sequence
  Description of Artificial Sequence: Synthetic peptide
GVDKRPP

SEQ ID NO: 113 - protein, 10 aa, Artificial Sequence
  Description of Artificial Sequence: Synthetic peptide
GSLVGNWDVI

SEQ ID NO: 114 - protein, 7 aa, Artificial Sequence
  Description of Artificial Sequence: Synthetic peptide
ACDYFWG

SEQ ID NO: 115 - protein, 22 aa, Artificial Sequence
  Description of Artificial Sequence: Synthetic peptide
GLSHCAGYYNTGWTYHNPSLKS

SEQ ID NO: 116 - protein, 19 aa, Artificial Sequence
  Description of Artificial Sequence: Synthetic peptide
FDGEVLVYHDWPKPAWVDL

SEQ ID NO: 117 - protein, 9 aa, Artificial Sequence
  Description of Artificial Sequence: Synthetic peptide
TGTSNRFVS

SEQ ID NO: 118 - protein, 7 aa, Artificial Sequence
  Description of Artificial Sequence: Synthetic peptide
GVNKRPS

SEQ ID NO: 119 - protein, 10 aa, Artificial Sequence
  Description of Artificial Sequence: Synthetic peptide
SSLVGNWDVI

SEQ ID NO: 120 - protein, 22 aa, Artificial Sequence
  Description of Artificial Sequence: Synthetic peptide
SLSHCAGYYNSGWTYHNPSLKS

SEQ ID NO: 121 - protein, 19 aa, Artificial Sequence
  Description of Artificial Sequence: Synthetic peptide
FGGDVLVYHDWPKPAWVDL

SEQ ID NO: 122 - protein, 9 aa, Artificial Sequence
  Description of Artificial Sequence: Synthetic peptide
TGNINNFVS

SEQ ID NO: 123 - protein, 10 aa, Artificial Sequence
  Description of Artificial Sequence: Synthetic peptide
GSLAGNWDVV

SEQ ID NO: 124 - protein, 7 aa, Artificial Sequence
  Description of Artificial Sequence: Synthetic peptide
ACNSFWG

SEQ ID NO: 125 - protein, 22 aa, Artificial Sequence
  Description of Artificial Sequence: Synthetic peptide
SLSHCASYWNRGWTYHNPSLKS

SEQ ID NO: 126 - protein, 19 aa, Artificial Sequence
  Description of Artificial Sequence: Synthetic peptide
FGGEVLRYTDWPKPAWVDL

SEQ ID NO: 127 - protein, 9 aa, Artificial Sequence
  Description of Artificial Sequence: Synthetic peptide
TGTSNNFVS

SEQ ID NO: 128 - protein, 7 aa, Artificial Sequence
  Description of Artificial Sequence: Synthetic peptide
DVNKRPS

SEQ ID NO: 129 - protein, 7 aa, Artificial Sequence
  Description of Artificial Sequence: Synthetic peptide
GCDYFWG

SEQ ID NO: 130 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 131 - protein, 19 aa, Artificial Sequence
  Description of Artificial Sequence: Synthetic peptide
FDGEVLVYNDWPKPAWVDL

SEQ ID NO: 132 - protein, 7 aa, Artificial Sequence
  Description of Artificial Sequence: Synthetic peptide
TGHYYWG

SEQ ID NO: 133 - protein, 16 aa, Artificial Sequence
  Description of Artificial Sequence: Synthetic peptide
HIHYTTAVLHNPSLKS

SEQ ID NO: 134 - protein, 19 aa, Artificial Sequence
  Description of Artificial Sequence: Synthetic peptide
SGGDILYYYEWQKPHWFSP

SEQ ID NO: 135 - protein, 14 aa, Artificial Sequence
  Description of Artificial Sequence: Synthetic peptide
NGTSSDIGGWNFVS

SEQ ID NO: 136 - protein, 7 aa, Artificial Sequence
  Description of Artificial Sequence: Synthetic peptide
EVNKRPS

SEQ ID NO: 137 - protein, 10 aa, Artificial Sequence
  Description of Artificial Sequence: Synthetic peptide
SSLFGRWDVV

SEQ ID NO: 138 - protein, 12 aa, Artificial Sequence
  Description of Artificial Sequence: Synthetic peptide
GTDWGENDFHYG

SEQ ID NO: 139 - protein, 17 aa, Artificial Sequence
  Description of Artificial Sequence: Synthetic peptide
SIHWRGRTTHYKTSFRS

SEQ ID NO: 140 - protein, 18 aa, Artificial Sequence
  Description of Artificial Sequence: Synthetic peptide
HKYHDIFRVVPVAGWFDP

SEQ ID NO: 141 - protein, 11 aa, Artificial Sequence
  Description of Artificial Sequence: Synthetic peptide
RASQNVKNNLA

SEQ ID NO: 142 - protein, 7 aa, Artificial Sequence
  Description of Artificial Sequence: Synthetic peptide
DASSRAG

SEQ ID NO: 143 - protein, 9 aa, Artificial Sequence
  Description of Artificial Sequence: Synthetic peptide
QQYEEWPRT

SEQ ID NO: 144 - protein, 12 aa, Artificial Sequence
  Description of Artificial Sequence: Synthetic peptide
GGEWGDSDYHWG

SEQ ID NO: 145 - protein, 16 aa, Artificial Sequence
  Description of Artificial Sequence: Synthetic peptide
SIHWRGTTHYNAPFRG

SEQ ID NO: 146 - protein, 18 aa, Artificial Sequence
  Description of Artificial Sequence: Synthetic peptide
HKYHDIVMVVPIAGWFDP

SEQ ID NO: 147 - protein, 11 aa, Artificial Sequence
  Description of Artificial Sequence: Synthetic peptide
RASQSVKNNLA

SEQ ID NO: 148 - protein, 7 aa, Artificial Sequence
  Description of Artificial Sequence: Synthetic peptide
DTSSRAS

SEQ ID NO: 149 - protein, 12 aa, Artificial Sequence
  Description of Artificial Sequence: Synthetic peptide
GGEWGDKDYHWG

SEQ ID NO: 150 - protein, 16 aa, Artificial Sequence
  Description of Artificial Sequence: Synthetic peptide
SIHWRGTTHYKESLRR

SEQ ID NO: 151 - protein, 18 aa, Artificial Sequence
  Description of Artificial Sequence: Synthetic peptide
HRHHDVFMLVPIAGWFDV

SEQ ID NO: 152 - protein, 11 aa, Artificial Sequence
  Description of Artificial Sequence: Synthetic peptide
RASQNINKNLA

SEQ ID NO: 153 - protein, 7 aa, Artificial Sequence
  Description of Artificial Sequence: Synthetic peptide
ETYSKIA

SEQ ID NO: 154 - protein, 6 aa, Artificial Sequence
  Description of Artificial Sequence: Synthetic peptide
SDHSWT

SEQ ID NO: 155 - protein, 16 aa, Artificial Sequence
  Description of Artificial Sequence: Synthetic peptide
DIHYNGATTYNPSLRS

SEQ ID NO: 156 - protein, 21 aa, Artificial Sequence
  Description of Artificial Sequence: Synthetic peptide
NAIRIYGVVALGEWFHYGMDV

SEQ ID NO: 157 - protein, 11 aa, Artificial Sequence
  Description of Artificial Sequence: Synthetic peptide
SGAPLTSRFTY

SEQ ID NO: 158 - protein, 7 aa, Artificial Sequence
  Description of Artificial Sequence: Synthetic peptide
RSSQRSS

SEQ ID NO: 159 - protein, 11 aa, Artificial Sequence
  Description of Artificial Sequence: Synthetic peptide
QSSDTSDSYKM

SEQ ID NO: 160 - protein, 5 aa, Artificial Sequence
  Description of Artificial Sequence: Synthetic peptide
DYFIH

SEQ ID NO: 161 - protein, 17 aa, Artificial Sequence
  Description of Artificial Sequence: Synthetic peptide
WINPKTGQPNNPRQFQG

SEQ ID NO: 162 - protein, 10 aa, Artificial Sequence
  Description of Artificial Sequence: Synthetic peptide
QRSDYWDFDV

SEQ ID NO: 163 - protein, 7 aa, Artificial Sequence
  Description of Artificial Sequence: Synthetic peptide
QANGYLN

SEQ ID NO: 164 - protein, 7 aa, Artificial Sequence
  Description of Artificial Sequence: Synthetic peptide
DGSKLER

SEQ ID NO: 165 - protein, 5 aa, Artificial Sequence
  Description of Artificial Sequence: Synthetic peptide
QVYEF

SEQ ID NO: 166 - protein, 5 aa, Artificial Sequence
  Description of Artificial Sequence: Synthetic peptide
DHFIH

SEQ ID NO: 167 - protein, 10 aa, Artificial Sequence
  Description of Artificial Sequence: Synthetic peptide
QRSDFWDFDV

SEQ ID NO: 168 - protein, 5 aa, Artificial Sequence
  Description of Artificial Sequence: Synthetic peptide
NCPIN

SEQ ID NO: 169 - protein, 17 aa, Artificial Sequence
  Description of Artificial Sequence: Synthetic peptide
WMKPRGGAVSYARQLQG

SEQ ID NO: 170 - protein, 16 aa, Artificial Sequence
  Description of Artificial Sequence: Synthetic peptide
GKYCTARDYYNWDFEH

SEQ ID NO: 171 - protein, 9 aa, Artificial Sequence
  Description of Artificial Sequence: Synthetic peptide
RTSQYGSLA

SEQ ID NO: 172 - protein, 7 aa, Artificial Sequence
  Description of Artificial Sequence: Synthetic peptide
SGSTRAA

SEQ ID NO: 173 - protein, 5 aa, Artificial Sequence
  Description of Artificial Sequence: Synthetic peptide
QQYEF

SEQ ID NO: 174 - protein, 17 aa, Artificial Sequence
  Description of Artificial Sequence: Synthetic peptide
WMKPRHGAVSYARQLQG

SEQ ID NO: 175 - protein, 5 aa, Artificial Sequence
  Description of Artificial Sequence: Synthetic peptide
DCTLN

SEQ ID NO: 176 - protein, 17 aa, Artificial Sequence
  Description of Artificial Sequence: Synthetic peptide
WLKPRGGAVNYARPLQG

SEQ ID NO: 177 - protein, 12 aa, Artificial Sequence
  Description of Artificial Sequence: Synthetic peptide
GKNCDYNWDFEH

SEQ ID NO: 178 - protein, 5 aa, Artificial Sequence
  Description of Artificial Sequence: Synthetic peptide
AHILF

SEQ ID NO: 179 - protein, 17 aa, Artificial Sequence
  Description of Artificial Sequence: Synthetic peptide
WIKPQYGAVNFGGGFRD

SEQ ID NO: 180 - protein, 13 aa, Artificial Sequence
  Description of Artificial Sequence: Synthetic peptide
DRSYGDSSWALDA

SEQ ID NO: 181 - protein, 11 aa, Artificial Sequence
  Description of Artificial Sequence: Synthetic peptide
QTSQGVGSDLH

SEQ ID NO: 182 - protein, 7 aa, Artificial Sequence
  Description of Artificial Sequence: Synthetic peptide
HTSSVED

SEQ ID NO: 183 - protein, 5 aa, Artificial Sequence
  Description of Artificial Sequence: Synthetic peptide
QVLQF

SEQ ID NO: 184 - protein, 11 aa, Artificial Sequence
  Description of Artificial Sequence: Synthetic peptide
SGFDFSRQGMH

SEQ ID NO: 185 - protein, 16 aa, Artificial Sequence
  Description of Artificial Sequence: Synthetic peptide
FIKYDGSEKYHADSVW

SEQ ID NO: 186 - protein, 28 aa, Artificial Sequence
  Description of Artificial Sequence: Synthetic peptide
EAGGPDYRNGYNYYDFYDGYYNYHYMDV

SEQ ID NO: 187 - protein, 14 aa, Artificial Sequence
  Description of Artificial Sequence: Synthetic peptide
NGTSNDVGGYESVS

SEQ ID NO: 188 - protein, 8 aa, Artificial Sequence
  Description of Artificial Sequence: Synthetic peptide
DVSKRPSG

SEQ ID NO: 189 - protein, 10 aa, Artificial Sequence
  Description of Artificial Sequence: Synthetic peptide
KSLTSTRRRV

SEQ ID NO: 190 - protein, 11 aa, Artificial Sequence
  Description of Artificial Sequence: Synthetic peptide
SGFTFHKYGMH

SEQ ID NO: 191 - protein, 16 aa, Artificial Sequence
  Description of Artificial Sequence: Synthetic peptide
LISDDGMRKYHSDSMW

SEQ ID NO: 192 - protein, 28 aa, Artificial Sequence
  Description of Artificial Sequence: Synthetic peptide
EAGGPIWHDDVKYYDFNDGYYNYHYMDV

SEQ ID NO: 193 - protein, 14 aa, Artificial Sequence
  Description of Artificial Sequence: Synthetic peptide
NGTSSDVGGFDSVS

SEQ ID NO: 194 - protein, 8 aa, Artificial Sequence
  Description of Artificial Sequence: Synthetic peptide
DVSHRPSG

SEQ ID NO: 195 - protein, 10 aa, Artificial Sequence
  Description of Artificial Sequence: Synthetic peptide
SSLTDRSHRI

SEQ ID NO: 196 - protein, 5 aa, Artificial Sequence
  Description of Artificial Sequence: Synthetic peptide
DYYLH

SEQ ID NO: 197 - protein, 17 aa, Artificial Sequence
  Description of Artificial Sequence: Synthetic peptide
LIDPENGEARYAEKFQG

SEQ ID NO: 198 - protein, 13 aa, Artificial Sequence
  Description of Artificial Sequence: Synthetic peptide
GAVGADSGSWFDP

SEQ ID NO: 199 - protein, 11 aa, Artificial Sequence
  Description of Artificial Sequence: Synthetic peptide
SGSKLGDKYVS

SEQ ID NO: 200 - protein, 7 aa, Artificial Sequence
  Description of Artificial Sequence: Synthetic peptide
ENDRRPS

SEQ ID NO: 201 - protein, 11 aa, Artificial Sequence
  Description of Artificial Sequence: Synthetic peptide
QAWETTTTTFV

SEQ ID NO: 202 - protein, 5 aa, Artificial Sequence
  Description of Artificial Sequence: Synthetic peptide
SYAFS

SEQ ID NO: 203 - protein, 17 aa, Artificial Sequence
  Description of Artificial Sequence: Synthetic peptide
MITPVFGETKYAPRFQG

SEQ ID NO: 204 - protein, 15 aa, Artificial Sequence
  Description of Artificial Sequence: Synthetic peptide
DRRVVPMATDNWLDP

SEQ ID NO: 205 - protein, 11 aa, Artificial Sequence
  Description of Artificial Sequence: Synthetic peptide
RASQTIHTYLN

SEQ ID NO: 206 - protein, 7 aa, Artificial Sequence
  Description of Artificial Sequence: Synthetic peptide
GASTLQS

SEQ ID NO: 207 - protein, 9 aa, Artificial Sequence
  Description of Artificial Sequence: Synthetic peptide
QQSYSTPRT

SEQ ID NO: 208 - protein, 5 aa, Artificial Sequence
  Description of Artificial Sequence: Synthetic peptide
NHDVH

SEQ ID NO: 209 - protein, 17 aa, Artificial Sequence
  Description of Artificial Sequence: Synthetic peptide
WMSHEGDKTGLAQKFQG

SEQ ID NO: 210 - protein, 31 aa, Artificial Sequence
  Description of Artificial Sequence: Synthetic polypeptide
GSKHRLRDYFLYNEYGPNYEEWGDYLATLDV

SEQ ID NO: 211 - protein, 16 aa, Artificial Sequence
  Description of Artificial Sequence: Synthetic peptide
KCSHSLQHSTGANYLA

SEQ ID NO: 212 - protein, 7 aa, Artificial Sequence
  Description of Artificial Sequence: Synthetic peptide
LATHRAS

SEQ ID NO: 213 - protein, 9 aa, Artificial Sequence
  Description of Artificial Sequence: Synthetic peptide
MQGLHSPWT

SEQ ID NO: 214 - protein, 5 aa, Artificial Sequence
  Description of Artificial Sequence: Synthetic peptide
KYDVH

SEQ ID NO: 215 - protein, 17 aa, Artificial Sequence
  Description of Artificial Sequence: Synthetic peptide
WISHERDKTESAQRFKG

SEQ ID NO: 216 - protein, 32 aa, Artificial Sequence
  Description of Artificial Sequence: Synthetic polypeptide
GSKHRLRDYVLYDDYGLINYQEWNDYLEFLDV

SEQ ID NO: 217 - protein, 16 aa, Artificial Sequence
  Description of Artificial Sequence: Synthetic peptide
SSTQSLRHSNGANYLA

SEQ ID NO: 218 - protein, 7 aa, Artificial Sequence
  Description of Artificial Sequence: Synthetic peptide
LGSQRAS

SEQ ID NO: 219 - protein, 9 aa, Artificial Sequence
  Description of Artificial Sequence: Synthetic peptide
MQGLNRPWT

SEQ ID NO: 220 - protein, 17 aa, Artificial Sequence
  Description of Artificial Sequence: Synthetic peptide
WMSHEGDKTESAQRFKG

SEQ ID NO: 221 - protein, 16 aa, Artificial Sequence
  Description of Artificial Sequence: Synthetic peptide
TSTQSLRHSNGANYLA

SEQ ID NO: 222 - protein, 32 aa, Artificial Sequence
  Description of Artificial Sequence: Synthetic polypeptide
GSKHRLRDYVLYDDYGLINQQEWNDYLEFLDV

SEQ ID NO: 223 - protein, 5 aa, Artificial Sequence
  Description of Artificial Sequence: Synthetic peptide
KYPMY

SEQ ID NO: 224 - protein, 17 aa, Artificial Sequence
  Description of Artificial Sequence: Synthetic peptide
AISGDAWHVVYSNSVQG

SEQ ID NO: 225 - protein, 26 aa, Artificial Sequence
  Description of Artificial Sequence: Synthetic peptide
MFQESGPPRLDRWSGRNYYYYSGMDV

SEQ ID NO: 226 - protein, 16 aa, Artificial Sequence
  Description of Artificial Sequence: Synthetic peptide
KSSESLRQSNGKTSLY

SEQ ID NO: 227 - protein, 7 aa, Artificial Sequence
  Description of Artificial Sequence: Synthetic peptide
EVSNRFS

SEQ ID NO: 228 - protein, 9 aa, Artificial Sequence
  Description of Artificial Sequence: Synthetic peptide
MQSKDFPLT

SEQ ID NO: 229 - protein, 6 aa, Artificial Sequence
  Description of Artificial Sequence: Synthetic peptide
GLYAVN

SEQ ID NO: 230 - protein, 15 aa, Artificial Sequence
  Description of Artificial Sequence: Synthetic peptide
QIWRWKSSASHHFRG

SEQ ID NO: 231 - protein, 20 aa, Artificial Sequence
  Description of Artificial Sequence: Synthetic peptide
TSTYDKWSGLHHDGVMAFSS

SEQ ID NO: 232 - protein, 12 aa, Artificial Sequence
  Description of Artificial Sequence: Synthetic peptide
RASQSITGNWVA

SEQ ID NO: 233 - protein, 7 aa, Artificial Sequence
  Description of Artificial Sequence: Synthetic peptide
RGAALLG

SEQ ID NO: 234 - protein, 9 aa, Artificial Sequence
  Description of Artificial Sequence: Synthetic peptide
QQYDTYPGT

SEQ ID NO: 235 - protein, 6 aa, Artificial Sequence
  Description of Artificial Sequence: Synthetic peptide
GASISD

SEQ ID NO: 236 - protein, 3 aa, Artificial Sequence
  Description of Artificial Sequence: Synthetic peptide
KSG

SEQ ID NO: 237 - protein, 22 aa, Artificial Sequence
  Description of Artificial Sequence: Synthetic peptide
LHGRRIYGIVAFNEWFTYFYMD

SEQ ID NO: 238 - protein, 8 aa, Artificial Sequence
  Description of Artificial Sequence: Synthetic peptide
EKSLGSRA

SEQ ID NO: 239 - protein, 3 aa, Artificial Sequence
  Description of Artificial Sequence: Synthetic peptide
NNQ

SEQ ID NO: 240 - protein, 9 aa, Artificial Sequence
  Description of Artificial Sequence: Synthetic peptide
WDSRVPTKW

SEQ ID NO: 241 - protein, 7 aa, Artificial Sequence
  Description of Artificial Sequence: Synthetic peptide
GDSMNNY

SEQ ID NO: 242 - protein, 3 aa, Artificial Sequence
  Description of Artificial Sequence: Synthetic peptide
DRE

SEQ ID NO: 243 - protein, 22 aa, Artificial Sequence
  Description of Artificial Sequence: Synthetic peptide
RRGQRIYGVVSFGEFFYYYSMD

SEQ ID NO: 244 - protein, 8 aa, Artificial Sequence
  Description of Artificial Sequence: Synthetic peptide
RQALGSRA

SEQ ID NO: 245 - protein, 9 aa, Artificial Sequence
  Description of Artificial Sequence: Synthetic peptide
WDSRSGFSW

SEQ ID NO: 246 - protein, 7 aa, Artificial Sequence
  Description of Artificial Sequence: Synthetic peptide
GGSISNY

SEQ ID NO: 247 - protein, 22 aa, Artificial Sequence
  Description of Artificial Sequence: Synthetic peptide
RRGQRIYGVVSFGEFFYYYYMD

SEQ ID NO: 248 - protein, 7 aa, Artificial Sequence
  Description of Artificial Sequence: Synthetic peptide
NGSVSGR

SEQ ID NO: 249 - protein, 3 aa, Artificial Sequence
  Description of Artificial Sequence: Synthetic peptide
DTD

SEQ ID NO: 250 - protein, 22 aa, Artificial Sequence
  Description of Artificial Sequence: Synthetic peptide
QQGKRIYGIVSFGEFFYYYYMD

SEQ ID NO: 251 - protein, 8 aa, Artificial Sequence
  Description of Artificial Sequence: Synthetic peptide
ERSRGSRA

SEQ ID NO: 252 - protein, 9 aa, Artificial Sequence
  Description of Artificial Sequence: Synthetic peptide
WDSRSPISW

SEQ ID NO: 253 - protein, 22 aa, Artificial Sequence
  Description of Artificial Sequence: Synthetic peptide
QQGKRIYGIVSFGELFYYYYMD

SEQ ID NO: 254 - protein, 7 aa, Artificial Sequence
  Description of Artificial Sequence: Synthetic peptide
GTLVRDN

SEQ ID NO: 255 - protein, 3 aa, Artificial Sequence
  Description of Artificial Sequence: Synthetic peptide
DSG

SEQ ID NO: 256 - protein, 22 aa, Artificial Sequence
  Description of Artificial Sequence: Synthetic peptide
KHGRRIYGVVAFKEWFTYFYMD

SEQ ID NO: 257 - protein, 8 aa, Artificial Sequence
  Description of Artificial Sequence: Synthetic peptide
EESLGSRS

SEQ ID NO: 258 - protein, 3 aa, Artificial Sequence
  Description of Artificial Sequence: Synthetic peptide
NNN

SEQ ID NO: 259 - protein, 9 aa, Artificial Sequence
  Description of Artificial Sequence: Synthetic peptide
WDSRRPTNW

SEQ ID NO: 260 - protein, 7 aa, Artificial Sequence
  Description of Artificial Sequence: Synthetic peptide
GASINDA

SEQ ID NO: 261 - protein, 3 aa, Artificial Sequence
  Description of Artificial Sequence: Synthetic peptide
HSG

SEQ ID NO: 262 - protein, 22 aa, Artificial Sequence
  Description of Artificial Sequence: Synthetic peptide
LHGKRIYGIVALGELFTYFYMD

SEQ ID NO: 263 - protein, 8 aa, Artificial Sequence
  Description of Artificial Sequence: Synthetic peptide
KESIGSRA

SEQ ID NO: 264 - protein, 9 aa, Artificial Sequence
  Description of Artificial Sequence: Synthetic peptide
YDARGGTNW

SEQ ID NO: 265 - protein, 9 aa, Artificial Sequence
  Description of Artificial Sequence: Synthetic peptide
GESTGACTY

SEQ ID NO: 266 - protein, 9 aa, Artificial Sequence
  Description of Artificial Sequence: Synthetic peptide
HCQSFWGSG

SEQ ID NO: 267 - protein, 17 aa, Artificial Sequence
  Description of Artificial Sequence: Synthetic peptide
DGEVLVYNHWPKPAWVD

SEQ ID NO: 268 - protein, 6 aa, Artificial Sequence
  Description of Artificial Sequence: Synthetic peptide
GTATNF

SEQ ID NO: 269 - protein, 3 aa, Artificial Sequence
  Description of Artificial Sequence: Synthetic peptide
GVD

SEQ ID NO: 270 - protein, 7 aa, Artificial Sequence
  Description of Artificial Sequence: Synthetic peptide
LVGNWDV

SEQ ID NO: 271 - protein, 9 aa, Artificial Sequence
  Description of Artificial Sequence: Synthetic peptide
GDSTAACDY

SEQ ID NO: 272 - protein, 9 aa, Artificial Sequence
  Description of Artificial Sequence: Synthetic peptide
HCAGYYNTG

SEQ ID NO: 273 - protein, 17 aa, Artificial Sequence
  Description of Artificial Sequence: Synthetic peptide
DGEVLVYHDWPKPAWVD

SEQ ID NO: 274 - protein, 6 aa, Artificial Sequence
  Description of Artificial Sequence: Synthetic peptide
GTSNRF

SEQ ID NO: 275 - protein, 3 aa, Artificial Sequence
  Description of Artificial Sequence: Synthetic peptide
GVN

SEQ ID NO: 276 - protein, 9 aa, Artificial Sequence
  Description of Artificial Sequence: Synthetic peptide
HCAGYYNSG

SEQ ID NO: 277 - protein, 17 aa, Artificial Sequence
  Description of Artificial Sequence: Synthetic peptide
GGDVLVYHDWPKPAWVD

SEQ ID NO: 278 - protein, 6 aa, Artificial Sequence
  Description of Artificial Sequence: Synthetic peptide
GNINNF

SEQ ID NO: 279 - protein, 7 aa, Artificial Sequence
  Description of Artificial Sequence: Synthetic peptide
LAGNWDV

SEQ ID NO: 280 - protein, 9 aa, Artificial Sequence
  Description of Artificial Sequence: Synthetic peptide
GDSTAACNS

SEQ ID NO: 281 - protein, 9 aa, Artificial Sequence
  Description of Artificial Sequence: Synthetic peptide
HCASYWNRG

SEQ ID NO: 282 - protein, 17 aa, Artificial Sequence
  Description of Artificial Sequence: Synthetic peptide
GGEVLRYTDWPKPAWVD

SEQ ID NO: 283 - protein, 6 aa, Artificial Sequence
  Description of Artificial Sequence: Synthetic peptide
GTSNNF

SEQ ID NO: 284 - protein, 3 aa, Artificial Sequence
  Description of Artificial Sequence: Synthetic peptide
DVN

SEQ ID NO: 285 - protein, 9 aa, Artificial Sequence
  Description of Artificial Sequence: Synthetic peptide
GDSTAGCDY

SEQ ID NO: 286 - protein, 17 aa, Artificial Sequence
  Description of Artificial Sequence: Synthetic peptide
DGEVLVYNDWPKPAWVD

SEQ ID NO: 287 - protein, 9 aa, Artificial Sequence
  Description of Artificial Sequence: Synthetic peptide
GESINTGHY

SEQ ID NO: 288 - protein, 3 aa, Artificial Sequence
  Description of Artificial Sequence: Synthetic peptide
YTT

SEQ ID NO: 289 - protein, 17 aa, Artificial Sequence
  Description of Artificial Sequence: Synthetic peptide
GGDILYYYEWQKPHWFS

SEQ ID NO: 290 - protein, 11 aa, Artificial Sequence
  Description of Artificial Sequence: Synthetic peptide
GTSSDIGGWNF

SEQ ID NO: 291 - protein, 3 aa, Artificial Sequence
  Description of Artificial Sequence: Synthetic peptide
EVN

SEQ ID NO: 292 - protein, 7 aa, Artificial Sequence
  Description of Artificial Sequence: Synthetic peptide
LFGRWDV

SEQ ID NO: 293 - protein, 14 aa, Artificial Sequence
  Description of Artificial Sequence: Synthetic peptide
GGSMRGTDWGENDF

SEQ ID NO: 294 - protein, 4 aa, Artificial Sequence
  Description of Artificial Sequence: Synthetic peptide
WRGR

SEQ ID NO: 295 - protein, 16 aa, Artificial Sequence
  Description of Artificial Sequence: Synthetic peptide
KYHDIFRVVPVAGWFD

SEQ ID NO: 296 - protein, 7 aa, Artificial Sequence
  Description of Artificial Sequence: Synthetic peptide
SQNVKNN

SEQ ID NO: 297 - protein, 3 aa, Artificial Sequence
  Description of Artificial Sequence: Synthetic peptide
DAS

SEQ ID NO: 298 - protein, 6 aa, Artificial Sequence
  Description of Artificial Sequence: Synthetic peptide
YEEWPR

SEQ ID NO: 299 - protein, 14 aa, Artificial Sequence
  Description of Artificial Sequence: Synthetic peptide
GGSIRGGEWGDSDY

SEQ ID NO: 300 - protein, 3 aa, Artificial Sequence
  Description of Artificial Sequence: Synthetic peptide
WRG

SEQ ID NO: 301 - protein, 16 aa, Artificial Sequence
  Description of Artificial Sequence: Synthetic peptide
KYHDIVMVVPIAGWFD

SEQ ID NO: 302 - protein, 7 aa, Artificial Sequence
  Description of Artificial Sequence: Synthetic peptide
SQSVKNN

SEQ ID NO: 303 - protein, 3 aa, Artificial Sequence
  Description of Artificial Sequence: Synthetic peptide
DTS

SEQ ID NO: 304 - protein, 14 aa, Artificial Sequence
  Description of Artificial Sequence: Synthetic peptide
GDSIRGGEWGDKDY

SEQ ID NO: 305 - protein, 16 aa, Artificial Sequence
  Description of Artificial Sequence: Synthetic peptide
RHHDVFMLVPIAGWFD

SEQ ID NO: 306 - protein, 7 aa, Artificial Sequence
  Description of Artificial Sequence: Synthetic peptide
SQNINKN

SEQ ID NO: 307 - protein, 3 aa, Artificial Sequence
  Description of Artificial Sequence: Synthetic peptide
ETY

SEQ ID NO: 308 - protein, 8 aa, Artificial Sequence
  Description of Artificial Sequence: Synthetic peptide
QDSRPSDH

SEQ ID NO: 309 - protein, 3 aa, Artificial Sequence
  Description of Artificial Sequence: Synthetic peptide
YNG

SEQ ID NO: 310 - protein, 19 aa, Artificial Sequence
  Description of Artificial Sequence: Synthetic peptide
AIRIYGVVALGEWFHYGMD

SEQ ID NO: 311 - protein, 8 aa, Artificial Sequence
  Description of Artificial Sequence: Synthetic peptide
GAPLTSRF

SEQ ID NO: 312 - protein, 3 aa, Artificial Sequence
  Description of Artificial Sequence: Synthetic peptide
RSS

SEQ ID NO: 313 - protein, 8 aa, Artificial Sequence
  Description of Artificial Sequence: Synthetic peptide
SDTSDSYK

SEQ ID NO: 314 - protein, 7 aa, Artificial Sequence
  Description of Artificial Sequence: Synthetic peptide
GYNIRDY

SEQ ID NO: 315 - protein, 4 aa, Artificial Sequence
  Description of Artificial Sequence: Synthetic peptide
PKTG

SEQ ID NO: 316 - protein, 8 aa, Artificial Sequence
  Description of Artificial Sequence: Synthetic peptide
RSDYWDFD

SEQ ID NO: 317 - protein, 3 aa, Artificial Sequence
  Description of Artificial Sequence: Synthetic peptide
NGY

SEQ ID NO: 318 - protein, 3 aa, Artificial Sequence
  Description of Artificial Sequence: Synthetic peptide
DGS

SEQ ID NO: 319 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 320 - protein, 7 aa, Artificial Sequence
  Description of Artificial Sequence: Synthetic peptide
GYKISDH

SEQ ID NO: 321 - protein, 8 aa, Artificial Sequence
  Description of Artificial Sequence: Synthetic peptide
RSDFWDFD

SEQ ID NO: 322 - protein, 7 aa, Artificial Sequence
  Description of Artificial Sequence: Synthetic peptide
GYEFINC

SEQ ID NO: 323 - protein, 4 aa, Artificial Sequence
  Description of Artificial Sequence: Synthetic peptide
PRGG

SEQ ID NO: 324 - protein, 14 aa, Artificial Sequence
  Description of Artificial Sequence: Synthetic peptide
KYCTARDYYNWDFE

SEQ ID NO: 325 - protein, 5 aa, Artificial Sequence
  Description of Artificial Sequence: Synthetic peptide
SQYGS

SEQ ID NO: 326 - protein, 3 aa, Artificial Sequence
  Description of Artificial Sequence: Synthetic peptide
SGS

SEQ ID NO: 327 - protein, 2 aa, Artificial Sequence
  Description of Artificial Sequence: Synthetic peptide
YE

SEQ ID NO: 328 - protein, 4 aa, Artificial Sequence
  Description of Artificial Sequence: Synthetic peptide
PRHG

SEQ ID NO: 329 - protein, 7 aa, Artificial Sequence
  Description of Artificial Sequence: Synthetic peptide
GYEFIDC

SEQ ID NO: 330 - protein, 10 aa, Artificial Sequence
  Description of Artificial Sequence: Synthetic peptide
KNCDYNWDFE

SEQ ID NO: 331 - protein, 7 aa, Artificial Sequence
  Description of Artificial Sequence: Synthetic peptide
GYTFTAH

SEQ ID NO: 332 - protein, 4 aa, Artificial Sequence
  Description of Artificial Sequence: Synthetic peptide
PQYG

SEQ ID NO: 333 - protein, 11 aa, Artificial Sequence
  Description of Artificial Sequence: Synthetic peptide
RSYGDSSWALD

SEQ ID NO: 334 - protein, 7 aa, Artificial Sequence
  Description of Artificial Sequence: Synthetic peptide
SQGVGSD

SEQ ID NO: 335 - protein, 3 aa, Artificial Sequence
  Description of Artificial Sequence: Synthetic peptide
HTS

SEQ ID NO: 336 - protein, 2 aa, Artificial Sequence
  Description of Artificial Sequence: Synthetic peptide
LQ

SEQ ID NO: 337 - protein, 7 aa, Artificial Sequence
  Description of Artificial Sequence: Synthetic peptide
GFDFSRQ

SEQ ID NO: 338 - protein, 4 aa, Artificial Sequence
  Description of Artificial Sequence: Synthetic peptide
YDGS

SEQ ID NO: 339 - protein, 26 aa, Artificial Sequence
  Description of Artificial Sequence: Synthetic peptide
AGGPDYRNGYNYYDFYDGYYNYHYMD

SEQ ID NO: 340 - protein, 11 aa, Artificial Sequence
  Description of Artificial Sequence: Synthetic peptide
GTSNDVGGYES

SEQ ID NO: 341 - protein, 3 aa, Artificial Sequence
  Description of Artificial Sequence: Synthetic peptide
DVS

SEQ ID NO: 342 - protein, 7 aa, Artificial Sequence
  Description of Artificial Sequence: Synthetic peptide
LTSTRRR

SEQ ID NO: 343 - protein, 7 aa, Artificial Sequence
  Description of Artificial Sequence: Synthetic peptide
GFTFHKY

SEQ ID NO: 344 - protein, 4 aa, Artificial Sequence
  Description of Artificial Sequence: Synthetic peptide
DDGM

SEQ ID NO: 345 - protein, 26 aa, Artificial Sequence
  Description of Artificial Sequence: Synthetic peptide
AGGPIWHDDVKYYDFNDGYYNYHYMD

SEQ ID NO: 346 - protein, 11 aa, Artificial Sequence
  Description of Artificial Sequence: Synthetic peptide
GTSSDVGGFDS

SEQ ID NO: 347 - protein, 7 aa, Artificial Sequence
  Description of Artificial Sequence: Synthetic peptide
LTDRSHR

SEQ ID NO: 348 - protein, 7 aa, Artificial Sequence
  Description of Artificial Sequence: Synthetic peptide
GYSFIDY

SEQ ID NO: 349 - protein, 4 aa, Artificial Sequence
  Description of Artificial Sequence: Synthetic peptide
PENG

SEQ ID NO: 350 - protein, 11 aa, Artificial Sequence
  Description of Artificial Sequence: Synthetic peptide
AVGADSGSWFD

SEQ ID NO: 351 - protein, 8 aa, Artificial Sequence
  Description of Artificial Sequence: Synthetic peptide
GSKLGDKY

SEQ ID NO: 352 - protein, 3 aa, Artificial Sequence
  Description of Artificial Sequence: Synthetic peptide
END

SEQ ID NO: 353 - protein, 8 aa, Artificial Sequence
  Description of Artificial Sequence: Synthetic peptide
WETTTTTF

SEQ ID NO: 354 - protein, 7 aa, Artificial Sequence
  Description of Artificial Sequence: Synthetic peptide
GGAFSSY

SEQ ID NO: 355 - protein, 4 aa, Artificial Sequence
  Description of Artificial Sequence: Synthetic peptide
PVFG

SEQ ID NO: 356 - protein, 13 aa, Artificial Sequence
  Description of Artificial Sequence: Synthetic peptide
RRVVPMATDNWLD

SEQ ID NO: 357 - protein, 7 aa, Artificial Sequence
  Description of Artificial Sequence: Synthetic peptide
SQTIHTY

SEQ ID NO: 358 - protein, 3 aa, Artificial Sequence
  Description of Artificial Sequence: Synthetic peptide
GAS

SEQ ID NO: 359 - protein, 6 aa, Artificial Sequence
  Description of Artificial Sequence: Synthetic peptide
SYSTPR

SEQ ID NO: 360 - protein, 7 aa, Artificial Sequence
  Description of Artificial Sequence: Synthetic peptide
GNSFSNH

SEQ ID NO: 361 - protein, 4 aa, Artificial Sequence
  Description of Artificial Sequence: Synthetic peptide
HEGD

SEQ ID NO: 362 - protein, 29 aa, Artificial Sequence
  Description of Artificial Sequence: Synthetic peptide
SKHRLRDYFLYNEYGPNYEEWGDYLATLD

SEQ ID NO: 363 - protein, 12 aa, Artificial Sequence
  Description of Artificial Sequence: Synthetic peptide
SHSLQHSTGANY

SEQ ID NO: 364 - protein, 3 aa, Artificial Sequence
  Description of Artificial Sequence: Synthetic peptide
LAT

SEQ ID NO: 365 - protein, 6 aa, Artificial Sequence
  Description of Artificial Sequence: Synthetic peptide
GLHSPW

SEQ ID NO: 366 - protein, 7 aa, Artificial Sequence
  Description of Artificial Sequence: Synthetic peptide
GNTFSKY

SEQ ID NO: 367 - protein, 4 aa, Artificial Sequence
  Description of Artificial Sequence: Synthetic peptide
HERD

SEQ ID NO: 368 - protein, 30 aa, Artificial Sequence
  Description of Artificial Sequence: Synthetic polypeptide
SKHRLRDYVLYDDYGLINYQEWNDYLEFLD

SEQ ID NO: 369 - protein, 12 aa, Artificial Sequence
  Description of Artificial Sequence: Synthetic peptide
TQSLRHSNGANY

SEQ ID NO: 370 - protein, 3 aa, Artificial Sequence
  Description of Artificial Sequence: Synthetic peptide
LGS

SEQ ID NO: 371 - protein, 6 aa, Artificial Sequence
  Description of Artificial Sequence: Synthetic peptide
GLNRPW

SEQ ID NO: 372 - protein, 7 aa, Artificial Sequence
  Description of Artificial Sequence: Synthetic peptide
GNTFRKY

SEQ ID NO: 373 - protein, 30 aa, Artificial Sequence
  Description of Artificial Sequence: Synthetic polypeptide
SKHRLRDYVLYDDYGLINQQEWNDYLEFLD

SEQ ID NO: 374 - protein, 7 aa, Artificial Sequence
  Description of Artificial Sequence: Synthetic peptide
DFPFSKY

SEQ ID NO: 375 - protein, 4 aa, Artificial Sequence
  Description of Artificial Sequence: Synthetic peptide
GDAW

SEQ ID NO: 376 - protein, 24 aa, Artificial Sequence
  Description of Artificial Sequence: Synthetic peptide
FQESGPPRLDRWSGRNYYYYSGMD

SEQ ID NO: 377 - protein, 12 aa, Artificial Sequence
  Description of Artificial Sequence: Synthetic peptide
SESLRQSNGKTS

SEQ ID NO: 378 - protein, 3 aa, Artificial Sequence
  Description of Artificial Sequence: Synthetic peptide
EVS

SEQ ID NO: 379 - protein, 6 aa, Artificial Sequence
  Description of Artificial Sequence: Synthetic peptide
SKDFPL

SEQ ID NO: 380 - protein, 8 aa, Artificial Sequence
  Description of Artificial Sequence: Synthetic peptide
GVNTFGLY

SEQ ID NO: 381 - protein, 2 aa, Artificial Sequence
  Description of Artificial Sequence: Synthetic peptide
RW

SEQ ID NO: 382 - protein, 18 aa, Artificial Sequence
  Description of Artificial Sequence: Synthetic peptide
STYDKWSGLHHDGVMAFS

SEQ ID NO: 383 - protein, 8 aa, Artificial Sequence
  Description of Artificial Sequence: Synthetic peptide
SQSITGNW

SEQ ID NO: 384 - protein, 3 aa, Artificial Sequence
  Description of Artificial Sequence: Synthetic peptide
RGA

SEQ ID NO: 385 - protein, 6 aa, Artificial Sequence
  Description of Artificial Sequence: Synthetic peptide
YDTYPG

SEQ ID NO: 386 - protein, 8 aa, Artificial Sequence
  Description of Artificial Sequence: Synthetic peptide
GASISDSY

SEQ ID NO: 387 - protein, 7 aa, Artificial Sequence
  Description of Artificial Sequence: Synthetic peptide
VHKSGDT

SEQ ID NO: 388 - protein, 26 aa, Artificial Sequence
  Description of Artificial Sequence: Synthetic peptide
ARTLHGRRIYGIVAFNEWFTYFYMDV

SEQ ID NO: 389 - protein, 6 aa, Artificial Sequence
  Description of Artificial Sequence: Synthetic peptide
SLGSRA

SEQ ID NO: 390 - protein, 8 aa, Artificial Sequence
  Description of Artificial Sequence: Synthetic peptide
GDSMNNYY

SEQ ID NO: 391 - protein, 7 aa, Artificial Sequence
  Description of Artificial Sequence: Synthetic peptide
ISDRESA

SEQ ID NO: 392 - protein, 26 aa, Artificial Sequence
  Description of Artificial Sequence: Synthetic peptide
ATARRGQRIYGVVSFGEFFYYYSMDV

SEQ ID NO: 393 - protein, 6 aa, Artificial Sequence
  Description of Artificial Sequence: Synthetic peptide
ALGSRA

SEQ ID NO: 394 - protein, 26 aa, Artificial Sequence
  Description of Artificial Sequence: Synthetic peptide
ARARRGQRIYGVVSFGEFFYYYSMDV

SEQ ID NO: 395 - protein, 8 aa, Artificial Sequence
  Description of Artificial Sequence: Synthetic peptide
GGSISNYY

SEQ ID NO: 396 - protein, 7 aa, Artificial Sequence
  Description of Artificial Sequence: Synthetic peptide
ISDRETT

SEQ ID NO: 397 - protein, 26 aa, Artificial Sequence
  Description of Artificial Sequence: Synthetic peptide
ATARRGQRIYGVVSFGEFFYYYYMDV

SEQ ID NO: 398 - protein, 8 aa, Artificial Sequence
  Description of Artificial Sequence: Synthetic peptide
NGSVSGRF

SEQ ID NO: 399 - protein, 7 aa, Artificial Sequence
  Description of Artificial Sequence: Synthetic peptide
FSDTDRS

SEQ ID NO: 400 - protein, 26 aa, Artificial Sequence
  Description of Artificial Sequence: Synthetic peptide
ARAQQGKRIYGIVSFGELFYYYYMDA

SEQ ID NO: 401 - protein, 6 aa, Artificial Sequence
  Description of Artificial Sequence: Synthetic peptide
SRGSRA

SEQ ID NO: 402 - protein, 26 aa, Artificial Sequence
  Description of Artificial Sequence: Synthetic peptide
ARAQQGKRIYGIVSFGEFFYYYYMDA

SEQ ID NO: 403 - protein, 8 aa, Artificial Sequence
  Description of Artificial Sequence: Synthetic peptide
GASINDAY

SEQ ID NO: 404 - protein, 7 aa, Artificial Sequence
  Description of Artificial Sequence: Synthetic peptide
VHHSGDT

SEQ ID NO: 405 - protein, 26 aa, Artificial Sequence
  Description of Artificial Sequence: Synthetic peptide
ARALHGKRIYGIVALGELFTYFYMDV

SEQ ID NO: 406 - protein, 6 aa, Artificial Sequence
  Description of Artificial Sequence: Synthetic peptide
SLGSRS

SEQ ID NO: 407 - protein, 8 aa, Artificial Sequence
  Description of Artificial Sequence: Synthetic peptide
GTLVRDNY

SEQ ID NO: 408 - protein, 7 aa, Artificial Sequence
  Description of Artificial Sequence: Synthetic peptide
VHDSGDT

SEQ ID NO: 409 - protein, 26 aa, Artificial Sequence
  Description of Artificial Sequence: Synthetic peptide
ATTKHGRRIYGVVAFKEWFTYFYMDV

SEQ ID NO: 410 - protein, 6 aa, Artificial Sequence
  Description of Artificial Sequence: Synthetic peptide
SIGSRA

SEQ ID NO: 411 - protein, 10 aa, Artificial Sequence
  Description of Artificial Sequence: Synthetic peptide
GESTGACTYF

SEQ ID NO: 412 - protein, 13 aa, Artificial Sequence
  Description of Artificial Sequence: Synthetic peptide
LSHCQSFWGSGWT

SEQ ID NO: 413 - protein, 21 aa, Artificial Sequence
  Description of Artificial Sequence: Synthetic peptide
ARFDGEVLVYNHWPKPAWVDL

SEQ ID NO: 414 - protein, 4 aa, Artificial Sequence
  Description of Artificial Sequence: Synthetic peptide
ATNF

SEQ ID NO: 415 - protein, 10 aa, Artificial Sequence
  Description of Artificial Sequence: Synthetic peptide
GDSTAACDYF

SEQ ID NO: 416 - protein, 13 aa, Artificial Sequence
  Description of Artificial Sequence: Synthetic peptide
LSHCAGYYNTGWT

SEQ ID NO: 417 - protein, 21 aa, Artificial Sequence
  Description of Artificial Sequence: Synthetic peptide
ARFDGEVLVYHDWPKPAWVDL

SEQ ID NO: 418 - protein, 4 aa, Artificial Sequence
  Description of Artificial Sequence: Synthetic peptide
SNRF

SEQ ID NO: 419 - protein, 13 aa, Artificial Sequence
  Description of Artificial Sequence: Synthetic peptide
LSHCAGYYNSGWT

SEQ ID NO: 420 - protein, 21 aa, Artificial Sequence
  Description of Artificial Sequence: Synthetic peptide
ARFGGDVLVYHDWPKPAWVDL

SEQ ID NO: 421 - protein, 4 aa, Artificial Sequence
  Description of Artificial Sequence: Synthetic peptide
INNF

SEQ ID NO: 422 - protein, 10 aa, Artificial Sequence
  Description of Artificial Sequence: Synthetic peptide
GDSTAACNSF

SEQ ID NO: 423 - protein, 13 aa, Artificial Sequence
  Description of Artificial Sequence: Synthetic peptide
LSHCASYWNRGWT

SEQ ID NO: 424 - protein, 21 aa, Artificial Sequence
  Description of Artificial Sequence: Synthetic peptide
ARFGGEVLRYTDWPKPAWVDL

SEQ ID NO: 425 - protein, 4 aa, Artificial Sequence
  Description of Artificial Sequence: Synthetic peptide
SNNF

SEQ ID NO: 426 - protein, 10 aa, Artificial Sequence
  Description of Artificial Sequence: Synthetic peptide
GDSTAGCDYF

SEQ ID NO: 427 - protein, 21 aa, Artificial Sequence
  Description of Artificial Sequence: Synthetic peptide
ARFDGEVLVYNDWPKPAWVDL

SEQ ID NO: 428 - protein, 10 aa, Artificial Sequence
  Description of Artificial Sequence: Synthetic peptide
GESINTGHYY

SEQ ID NO: 429 - protein, 7 aa, Artificial Sequence
  Description of Artificial Sequence: Synthetic peptide
IHYTTAV

SEQ ID NO: 430 - protein, 21 aa, Artificial Sequence
  Description of Artificial Sequence: Synthetic peptide
VRSGGDILYYYEWQKPHWFSP

SEQ ID NO: 431 - protein, 9 aa, Artificial Sequence
  Description of Artificial Sequence: Synthetic peptide
SSDIGGWNF

SEQ ID NO: 432 - protein, 15 aa, Artificial Sequence
  Description of Artificial Sequence: Synthetic peptide
GGSMRGTDWGENDFH

SEQ ID NO: 433 - protein, 8 aa, Artificial Sequence
  Description of Artificial Sequence: Synthetic peptide
IHWRGRTT

SEQ ID NO: 434 - protein, 20 aa, Artificial Sequence
  Description of Artificial Sequence: Synthetic peptide
ARHKYHDIFRVVPVAGWFDP

SEQ ID NO: 435 - protein, 6 aa, Artificial Sequence
  Description of Artificial Sequence: Synthetic peptide
QNVKNN

SEQ ID NO: 436 - protein, 15 aa, Artificial Sequence
  Description of Artificial Sequence: Synthetic peptide
GGSIRGGEWGDSDYH

SEQ ID NO: 437 - protein, 7 aa, Artificial Sequence
  Description of Artificial Sequence: Synthetic peptide
IHWRGTT

SEQ ID NO: 438 - protein, 20 aa, Artificial Sequence
  Description of Artificial Sequence: Synthetic peptide
VKHKYHDIVMVVPIAGWFDP

SEQ ID NO: 439 - protein, 6 aa, Artificial Sequence
  Description of Artificial Sequence: Synthetic peptide
QSVKNN

SEQ ID NO: 440 - protein, 15 aa, Artificial Sequence
  Description of Artificial Sequence: Synthetic peptide
GDSIRGGEWGDKDYH

SEQ ID NO: 441 - protein, 20 aa, Artificial Sequence
  Description of Artificial Sequence: Synthetic peptide
ARHRHHDVFMLVPIAGWFDV

SEQ ID NO: 442 - protein, 6 aa, Artificial Sequence
  Description of Artificial Sequence: Synthetic peptide
QNINKN

SEQ ID NO: 443 - protein, 9 aa, Artificial Sequence
  Description of Artificial Sequence: Synthetic peptide
QDSRPSDHS

SEQ ID NO: 444 - protein, 7 aa, Artificial Sequence
  Description of Artificial Sequence: Synthetic peptide
IHYNGAT

SEQ ID NO: 445 - protein, 21 aa, Artificial Sequence
  Description of Artificial Sequence: Synthetic peptide
NAIRIYGVVALGEWFHYGMDV

SEQ ID NO: 446 - protein, 6 aa, Artificial Sequence
  Description of Artificial Sequence: Synthetic peptide
PLTSRF

SEQ ID NO: 447 - protein, 8 aa, Artificial Sequence
  Description of Artificial Sequence: Synthetic peptide
GYNIRDYF

SEQ ID NO: 448 - protein, 8 aa, Artificial Sequence
  Description of Artificial Sequence: Synthetic peptide
INPKTGQP

SEQ ID NO: 449 - protein, 12 aa, Artificial Sequence
  Description of Artificial Sequence: Synthetic peptide
ARQRSDYWDFDV

SEQ ID NO: 450 - protein, 3 aa, Artificial Sequence
  Description of Artificial Sequence: Synthetic peptide
NGY

SEQ ID NO: 451 - protein, 8 aa, Artificial Sequence
  Description of Artificial Sequence: Synthetic peptide
GYKISDHF

SEQ ID NO: 452 - protein, 12 aa, Artificial Sequence
  Description of Artificial Sequence: Synthetic peptide
ARQRSDFWDFDV

SEQ ID NO: 453 - protein, 8 aa, Artificial Sequence
  Description of Artificial Sequence: Synthetic peptide
GYEFINCP

SEQ ID NO: 454 - protein, 8 aa, Artificial Sequence
  Description of Artificial Sequence: Synthetic peptide
MKPRGGAV

SEQ ID NO: 455 - protein, 18 aa, Artificial Sequence
  Description of Artificial Sequence: Synthetic peptide
TRGKYCTARDYYNWDFEH

SEQ ID NO: 456 - protein, 4 aa, Artificial Sequence
  Description of Artificial Sequence: Synthetic peptide
QYGS

SEQ ID NO: 457 - protein, 8 aa, Artificial Sequence
  Description of Artificial Sequence: Synthetic peptide
MKPRHGAV

SEQ ID NO: 458 - protein, 8 aa, Artificial Sequence
  Description of Artificial Sequence: Synthetic peptide
GYEFIDCT

SEQ ID NO: 459 - protein, 8 aa, Artificial Sequence
  Description of Artificial Sequence: Synthetic peptide
LKPRGGAV

SEQ ID NO: 460 - protein, 14 aa, Artificial Sequence
  Description of Artificial Sequence: Synthetic peptide
TRGKNCDYNWDFEH

SEQ ID NO: 461 - protein, 8 aa, Artificial Sequence
  Description of Artificial Sequence: Synthetic peptide
GYTFTAHI

SEQ ID NO: 462 - protein, 8 aa, Artificial Sequence
  Description of Artificial Sequence: Synthetic peptide
IKPQYGAV

SEQ ID NO: 463 - protein, 15 aa, Artificial Sequence
  Description of Artificial Sequence: Synthetic peptide
ARDRSYGDSSWALDA

SEQ ID NO: 464 - protein, 6 aa, Artificial Sequence
  Description of Artificial Sequence: Synthetic peptide
QGVGSD

SEQ ID NO: 465 - protein, 8 aa, Artificial Sequence
  Description of Artificial Sequence: Synthetic peptide
GFDFSRQG

SEQ ID NO: 466 - protein, 8 aa, Artificial Sequence
  Description of Artificial Sequence: Synthetic peptide
IKYDGSEK

SEQ ID NO: 467 - protein, 30 aa, Artificial Sequence
  Description of Artificial Sequence: Synthetic polypeptide
VREAGGPDYRNGYNYYDFYDGYYNYHYMDV

SEQ ID NO: 468 - protein, 9 aa, Artificial Sequence
  Description of Artificial Sequence: Synthetic peptide
SNDVGGYES

SEQ ID NO: 469 - protein, 8 aa, Artificial Sequence
  Description of Artificial Sequence: Synthetic peptide
GFTFHKYG

SEQ ID NO: 470 - protein, 8 aa, Artificial Sequence
  Description of Artificial Sequence: Synthetic peptide
ISDDGMRK

SEQ ID NO: 471 - protein, 30 aa, Artificial Sequence
  Description of Artificial Sequence: Synthetic polypeptide
AREAGGPIWHDDVKYYDFNDGYYNYHYMDV

SEQ ID NO: 472 - protein, 9 aa, Artificial Sequence
  Description of Artificial Sequence: Synthetic peptide
SSDVGGFDS

SEQ ID NO: 473 - protein, 8 aa, Artificial Sequence
  Description of Artificial Sequence: Synthetic peptide
GYSFIDYY

SEQ ID NO: 474 - protein, 8 aa, Artificial Sequence
  Description of Artificial Sequence: Synthetic peptide
IDPENGEA

SEQ ID NO: 475 - protein, 15 aa, Artificial Sequence
  Description of Artificial Sequence: Synthetic peptide
AAGAVGADSGSWFDP

SEQ ID NO: 476 - protein, 6 aa, Artificial Sequence
  Description of Artificial Sequence: Synthetic peptide
KLGDKY

SEQ ID NO: 477 - protein, 8 aa, Artificial Sequence
  Description of Artificial Sequence: Synthetic peptide
GGAFSSYA

SEQ ID NO: 478 - protein, 8 aa, Artificial Sequence
  Description of Artificial Sequence: Synthetic peptide
ITPVFGET

SEQ ID NO: 479 - protein, 17 aa, Artificial Sequence
  Description of Artificial Sequence: Synthetic peptide
TRDRRVVPMATDNWLDP

SEQ ID NO: 480 - protein, 6 aa, Artificial Sequence
  Description of Artificial Sequence: Synthetic peptide
QTIHTY

SEQ ID NO: 481 - protein, 8 aa, Artificial Sequence
  Description of Artificial Sequence: Synthetic peptide
GNSFSNHD

SEQ ID NO: 482 - protein, 8 aa, Artificial Sequence
  Description of Artificial Sequence: Synthetic peptide
MSHEGDKT

SEQ ID NO: 483 - protein, 33 aa, Artificial Sequence
  Description of Artificial Sequence: Synthetic polypeptide
LTGSKHRLRDYFLYNEYGPNYEEWGDYLATLDV

SEQ ID NO: 484 - protein, 11 aa, Artificial Sequence
  Description of Artificial Sequence: Synthetic peptide
HSLQHSTGANY

SEQ ID NO: 485 - protein, 8 aa, Artificial Sequence
  Description of Artificial Sequence: Synthetic peptide
GNTFSKYD

SEQ ID NO: 486 - protein, 8 aa, Artificial Sequence
  Description of Artificial Sequence: Synthetic peptide
ISHERDKT

SEQ ID NO: 487 - protein, 34 aa, Artificial Sequence
  Description of Artificial Sequence: Synthetic polypeptide
TRGSKHRLRDYVLYDDYGLINYQEWNDYLEFLDV

SEQ ID NO: 488 - protein, 11 aa, Artificial Sequence
  Description of Artificial Sequence: Synthetic peptide
QSLRHSNGANY

SEQ ID NO: 489 - protein, 8 aa, Artificial Sequence
  Description of Artificial Sequence: Synthetic peptide
GNTFRKYD

SEQ ID NO: 490 - protein, 34 aa, Artificial Sequence
  Description of Artificial Sequence: Synthetic polypeptide
TGGSKHRLRDYVLYDDYGLINQQEWNDYLEFLDV

SEQ ID NO: 491 - protein, 8 aa, Artificial Sequence
  Description of Artificial Sequence: Synthetic peptide
DFPFSKYP

SEQ ID NO: 492 - protein, 8 aa, Artificial Sequence
  Description of Artificial Sequence: Synthetic peptide
ISGDAWHV

SEQ ID NO: 493 - protein, 28 aa, Artificial Sequence
  Description of Artificial Sequence: Synthetic peptide
ARMFQESGPPRLDRWSGRNYYYYSGMDV

SEQ ID NO: 494 - protein, 11 aa, Artificial Sequence
  Description of Artificial Sequence: Synthetic peptide
ESLRQSNGKTS

SEQ ID NO: 495 - protein, 9 aa, Artificial Sequence
  Description of Artificial Sequence: Synthetic peptide
GVNTFGLYA

SEQ ID NO: 496 - protein, 6 aa, Artificial Sequence
  Description of Artificial Sequence: Synthetic peptide
IWRWKS

SEQ ID NO: 497 - protein, 22 aa, Artificial Sequence
  Description of Artificial Sequence: Synthetic peptide
TTTSTYDKWSGLHHDGVMAFSS

SEQ ID NO: 498 - protein, 7 aa, Artificial Sequence
  Description of Artificial Sequence: Synthetic peptide
QSITGNW

SEQ ID NO: 499 - protein, 10 aa, Artificial Sequence
  Description of Artificial Sequence: Synthetic peptide
VSGASISDSY

SEQ ID NO: 500 - protein, 16 aa, Artificial Sequence
  Description of Artificial Sequence: Synthetic peptide
VHKSGDTNYSPSLKSR

SEQ ID NO: 501 - protein, 23 aa, Artificial Sequence
  Description of Artificial Sequence: Synthetic peptide
TLHGRRIYGIVAFNEWFTYFYMD

SEQ ID NO: 502 - protein, 12 aa, Artificial Sequence
  Description of Artificial Sequence: Synthetic peptide
NNQDRPSGIPER

SEQ ID NO: 503 - protein, 16 aa, Artificial Sequence
  Description of Artificial Sequence: Synthetic peptide
VHKSGDTNYNPSLKSR

SEQ ID NO: 504 - protein, 12 aa, Homo sapiens
ESKYGPPCPPCP

SEQ ID NO: 505 - protein, 10 aa, Artificial Sequence
  Description of Artificial Sequence: Synthetic peptide
VSGDSMNNYY

SEQ ID NO: 506 - protein, 16 aa, Artificial Sequence
  Description of Artificial Sequence: Synthetic peptide
ISDRESATYNPSLNSR

SEQ ID NO: 507 - protein, 23 aa, Artificial Sequence
  Description of Artificial Sequence: Synthetic peptide
ARRGQRIYGVVSFGEFFYYYSMD

SEQ ID NO: 508 - protein, 10 aa, Artificial Sequence
  Description of Artificial Sequence: Synthetic peptide
VSGGSISNYY

SEQ ID NO: 509 - protein, 16 aa, Artificial Sequence
  Description of Artificial Sequence: Synthetic peptide
ISDRETTTYNPSLNSR

SEQ ID NO: 510 - protein, 23 aa, Artificial Sequence
  Description of Artificial Sequence: Synthetic peptide
ARRGQRIYGVVSFGEFFYYYYMD

SEQ ID NO: 511 - protein, 10 aa, Artificial Sequence
  Description of Artificial Sequence: Synthetic peptide
VSNGSVSGRF

SEQ ID NO: 512 - protein, 16 aa, Artificial Sequence
  Description of Artificial Sequence: Synthetic peptide
FSDTDRSEYNPSLRSR

SEQ ID NO: 513 - protein, 23 aa, Artificial Sequence
  Description of Artificial Sequence: Synthetic peptide
AQQGKRIYGIVSFGELFYYYYMD

SEQ ID NO: 514 - protein, 12 aa, Artificial Sequence
  Description of Artificial Sequence: Synthetic peptide
NNQDRPAGVSER

SEQ ID NO: 515 - protein, 23 aa, Artificial Sequence
  Description of Artificial Sequence: Synthetic peptide
AQQGKRIYGIVSFGEFFYYYYMD

SEQ ID NO: 516 - protein, 10 aa, Artificial Sequence
  Description of Artificial Sequence: Synthetic peptide
VSGTLVRDNY

SEQ ID NO: 517 - protein, 16 aa, Artificial Sequence
  Description of Artificial Sequence: Synthetic peptide
VHDSGDTNYNPSLKSR

SEQ ID NO: 518 - protein, 23 aa, Artificial Sequence
  Description of Artificial Sequence: Synthetic peptide
TKHGRRIYGVVAFKEWFTYFYMD

SEQ ID NO: 519 - protein, 12 aa, Artificial Sequence
  Description of Artificial Sequence: Synthetic peptide
NNNDRPSGIPDR

SEQ ID NO: 520 - protein, 10 aa, Artificial Sequence
  Description of Artificial Sequence: Synthetic peptide
VSGASINDAY

SEQ ID NO: 521 - protein, 16 aa, Artificial Sequence
  Description of Artificial Sequence: Synthetic peptide
VHHSGDTNYNPSLKRR

SEQ ID NO: 522 - protein, 23 aa, Artificial Sequence
  Description of Artificial Sequence: Synthetic peptide
ALHGKRIYGIVALGELFTYFYMD

SEQ ID NO: 523 - protein, 12 aa, Artificial Sequence
  Description of Artificial Sequence: Synthetic peptide
NNQDRPAGVPER

SEQ ID NO: 524 - protein, 12 aa, Artificial Sequence
  Description of Artificial Sequence: Synthetic peptide
VSGESTGACTYF

SEQ ID NO: 525 - protein, 22 aa, Artificial Sequence
  Description of Artificial Sequence: Synthetic peptide
LSHCQSFWGSGWTFHNPSLKSR

SEQ ID NO: 526 - protein, 18 aa, Artificial Sequence
  Description of Artificial Sequence: Synthetic peptide
FDGEVLVYNHWPKPAWVD

SEQ ID NO: 527 - protein, 12 aa, Artificial Sequence
  Description of Artificial Sequence: Synthetic peptide
GVDKRPPGVPDR

SEQ ID NO: 528 - protein, 12 aa, Artificial Sequence
  Description of Artificial Sequence: Synthetic peptide
VSGDSTAACDYF

SEQ ID NO: 529 - protein, 22 aa, Artificial Sequence
  Description of Artificial Sequence: Synthetic peptide
LSHCAGYYNTGWTYHNPSLKSR

SEQ ID NO: 530 - protein, 18 aa, Artificial Sequence
  Description of Artificial Sequence: Synthetic peptide
FDGEVLVYHDWPKPAWVD

SEQ ID NO: 531 - protein, 12 aa, Artificial Sequence
  Description of Artificial Sequence: Synthetic peptide
GVNKRPSGVPDR

SEQ ID NO: 532 - protein, 22 aa, Artificial Sequence
  Description of Artificial Sequence: Synthetic peptide
LSHCAGYYNSGWTYHNPSLKSR

SEQ ID NO: 533 - protein, 18 aa, Artificial Sequence
  Description of Artificial Sequence: Synthetic peptide
FGGDVLVYHDWPKPAWVD

SEQ ID NO: 534 - protein, 12 aa, Artificial Sequence
  Description of Artificial Sequence: Synthetic peptide
VSGDSTAACNSF

SEQ ID NO: 535 - protein, 22 aa, Artificial Sequence
  Description of Artificial Sequence: Synthetic peptide
LSHCASYWNRGWTYHNPSLKSR

SEQ ID NO: 536 - protein, 18 aa, Artificial Sequence
  Description of Artificial Sequence: Synthetic peptide
FGGEVLRYTDWPKPAWVD

SEQ ID NO: 537 - protein, 12 aa, Artificial Sequence
  Description of Artificial Sequence: Synthetic peptide
DVNKRPSGVPDR

SEQ ID NO: 538 - protein, 18 aa, Artificial Sequence
  Description of Artificial Sequence: Synthetic peptide
FDGEVLVYNDWPKPAWVD

SEQ ID NO: 539 - protein, 12 aa, Artificial Sequence
  Description of Artificial Sequence: Synthetic peptide
VSGESINTGHYY

SEQ ID NO: 540 - protein, 16 aa, Artificial Sequence
  Description of Artificial Sequence: Synthetic peptide
IHYTTAVLHNPSLKSR

SEQ ID NO: 541 - protein, 18 aa, Artificial Sequence
  Description of Artificial Sequence: Synthetic peptide
SGGDILYYYEWQKPHWFS

SEQ ID NO: 542 - protein, 12 aa, Artificial Sequence
  Description of Artificial Sequence: Synthetic peptide
EVNKRPSGVPGR

SEQ ID NO: 543 - protein, 17 aa, Artificial Sequence
  Description of Artificial Sequence: Synthetic peptide
VSGGSMRGTDWGENDFH

SEQ ID NO: 544 - protein, 17 aa, Artificial Sequence
  Description of Artificial Sequence: Synthetic peptide
IHWRGRTTHYKTSFRSR

SEQ ID NO: 545 - protein, 17 aa, Artificial Sequence
  Description of Artificial Sequence: Synthetic peptide
HKYHDIFRVVPVAGWFD

SEQ ID NO: 546 - protein, 8 aa, Artificial Sequence
  Description of Artificial Sequence: Synthetic peptide
ASQNVKNN

SEQ ID NO: 547 - protein, 12 aa, Artificial Sequence
  Description of Artificial Sequence: Synthetic peptide
DASSRAGGIPDR

SEQ ID NO: 548 - protein, 17 aa, Artificial Sequence
  Description of Artificial Sequence: Synthetic peptide
ASGGSIRGGEWGDSDYH

SEQ ID NO: 549 - protein, 16 aa, Artificial Sequence
  Description of Artificial Sequence: Synthetic peptide
IHWRGTTHYNAPFRGR

SEQ ID NO: 550 - protein, 17 aa, Artificial Sequence
  Description of Artificial Sequence: Synthetic peptide
HKYHDIVMVVPIAGWFD

SEQ ID NO: 551 - protein, 12 aa, Artificial Sequence
  Description of Artificial Sequence: Synthetic peptide
DTSSRASGIPAR

SEQ ID NO: 552 - protein, 17 aa, Artificial Sequence
  Description of Artificial Sequence: Synthetic peptide
VSGDSIRGGEWGDKDYH

SEQ ID NO: 553 - protein, 16 aa, Artificial Sequence
  Description of Artificial Sequence: Synthetic peptide
IHWRGTTHYKESLRRR

SEQ ID NO: 554 - protein, 17 aa, Artificial Sequence
  Description of Artificial Sequence: Synthetic peptide
HRHHDVFMLVPIAGWFD

SEQ ID NO: 555 - protein, 8 aa, Artificial Sequence
  Description of Artificial Sequence: Synthetic peptide
ASQNINKN

SEQ ID NO: 556 - protein, 12 aa, Artificial Sequence
  Description of Artificial Sequence: Synthetic peptide
ETYSKIAAFPAR

SEQ ID NO: 557 - protein, 11 aa, Artificial Sequence
  Description of Artificial Sequence: Synthetic peptide
VSQDSRPSDHS

SEQ ID NO: 558 - protein, 16 aa, Artificial Sequence
  Description of Artificial Sequence: Synthetic peptide
IHYNGATTYNPSLRSR

SEQ ID NO: 559 - protein, 20 aa, Artificial Sequence
  Description of Artificial Sequence: Synthetic peptide
NAIRIYGVVALGEWFHYGMD

SEQ ID NO: 560 - protein, 12 aa, Artificial Sequence
  Description of Artificial Sequence: Synthetic peptide
RSSQRSSGWSGR

SEQ ID NO: 561 - protein, 10 aa, Artificial Sequence
  Description of Artificial Sequence: Synthetic peptide
ASGYNIRDYF

SEQ ID NO: 562 - protein, 17 aa, Artificial Sequence
  Description of Artificial Sequence: Synthetic peptide
INPKTGQPNNPRQFQGR

SEQ ID NO: 563 - protein, 9 aa, Artificial Sequence
  Description of Artificial Sequence: Synthetic peptide
QRSDYWDFD

SEQ ID NO: 564 - protein, 4 aa, Artificial Sequence
  Description of Artificial Sequence: Synthetic peptide
ANGY

SEQ ID NO: 565 - protein, 13 aa, Artificial Sequence
  Description of Artificial Sequence: Synthetic peptide
DGSKLERGVPSRF

SEQ ID NO: 566 - protein, 10 aa, Artificial Sequence
  Description of Artificial Sequence: Synthetic peptide
ASGYKISDHF

SEQ ID NO: 567 - protein, 12 aa, Artificial Sequence
  Description of Artificial Sequence: Synthetic peptide
DGSKLERGVPAR

SEQ ID NO: 568 - protein, 10 aa, Artificial Sequence
  Description of Artificial Sequence: Synthetic peptide
ASGYEFINCP

SEQ ID NO: 569 - protein, 17 aa, Artificial Sequence
  Description of Artificial Sequence: Synthetic peptide
MKPRGGAVSYARQLQGR

SEQ ID NO: 570 - protein, 15 aa, Artificial Sequence
  Description of Artificial Sequence: Synthetic peptide
GKYCTARDYYNWDFE

SEQ ID NO: 571 - protein, 6 aa, Artificial Sequence
  Description of Artificial Sequence: Synthetic peptide
TSQYGS

SEQ ID NO: 572 - protein, 12 aa, Artificial Sequence
  Description of Artificial Sequence: Synthetic peptide
SGSTRAAGIPDR

SEQ ID NO: 573 - protein, 17 aa, Artificial Sequence
  Description of Artificial Sequence: Synthetic peptide
MKPRHGAVSYARQLQGR

SEQ ID NO: 574 - protein, 10 aa, Artificial Sequence
  Description of Artificial Sequence: Synthetic peptide
ASGYEFIDCT

SEQ ID NO: 575 - protein, 17 aa, Artificial Sequence
  Description of Artificial Sequence: Synthetic peptide
LKPRGGAVNYARPLQGR

SEQ ID NO: 576 - protein, 11 aa, Artificial Sequence
  Description of Artificial Sequence: Synthetic peptide
GKNCDYNWDFE

SEQ ID NO: 577 - protein, 10 aa, Artificial Sequence
  Description of Artificial Sequence: Synthetic peptide
TSGYTFTAHI

SEQ ID NO: 578 - protein, 17 aa, Artificial Sequence
  Description of Artificial Sequence: Synthetic peptide
IKPQYGAVNFGGGFRDR

SEQ ID NO: 579 - protein, 12 aa, Artificial Sequence
  Description of Artificial Sequence: Synthetic peptide
DRSYGDSSWALD

SEQ ID NO: 580 - protein, 8 aa, Artificial Sequence
  Description of Artificial Sequence: Synthetic peptide
TSQGVGSD

SEQ ID NO: 581 - protein, 12 aa, Artificial Sequence
  Description of Artificial Sequence: Synthetic peptide
HTSSVEDGVPSR

SEQ ID NO: 582 - protein, 10 aa, Artificial Sequence
  Description of Artificial Sequence: Synthetic peptide
ASGFDFSRQG

SEQ ID NO: 583 - protein, 17 aa, Artificial Sequence
  Description of Artificial Sequence: Synthetic peptide
IKYDGSEKYHADSVWGR

SEQ ID NO: 584 - protein, 27 aa, Artificial Sequence
  Description of Artificial Sequence: Synthetic peptide
EAGGPDYRNGYNYYDFYDGYYNYHYMD

SEQ ID NO: 585 - protein, 12 aa, Artificial Sequence
  Description of Artificial Sequence: Synthetic peptide
DVSKRPSGVSNR

SEQ ID NO: 586 - protein, 10 aa, Artificial Sequence
  Description of Artificial Sequence: Synthetic peptide
ASGFTFHKYG

SEQ ID NO: 587 - protein, 17 aa, Artificial Sequence
  Description of Artificial Sequence: Synthetic peptide
ISDDGMRKYHSDSMWGR

SEQ ID NO: 588 - protein, 27 aa, Artificial Sequence
  Description of Artificial Sequence: Synthetic peptide
EAGGPIWHDDVKYYDFNDGYYNYHYMD

SEQ ID NO: 589 - protein, 12 aa, Artificial Sequence
  Description of Artificial Sequence: Synthetic peptide
DVSHRPSGISNR

SEQ ID NO: 590 - protein, 10 aa, Artificial Sequence
  Description of Artificial Sequence: Synthetic peptide
VSGYSFIDYY

SEQ ID NO: 591 - protein, 17 aa, Artificial Sequence
  Description of Artificial Sequence: Synthetic peptide
IDPENGEARYAEKFQGR

SEQ ID NO: 592 - protein, 12 aa, Artificial Sequence
  Description of Artificial Sequence: Synthetic peptide
GAVGADSGSWFD

SEQ ID NO: 593 - protein, 12 aa, Artificial Sequence
  Description of Artificial Sequence: Synthetic peptide
ENDRRPSGIPER

SEQ ID NO: 594 - protein, 10 aa, Artificial Sequence
  Description of Artificial Sequence: Synthetic peptide
ASGGAFSSYA

SEQ ID NO: 595 - protein, 17 aa, Artificial Sequence
  Description of Artificial Sequence: Synthetic peptide
ITPVFGETKYAPRFQGR

SEQ ID NO: 596 - protein, 14 aa, Artificial Sequence
  Description of Artificial Sequence: Synthetic peptide
DRRVVPMATDNWLD

SEQ ID NO: 597 - protein, 8 aa, Artificial Sequence
  Description of Artificial Sequence: Synthetic peptide
ASQTIHTY

SEQ ID NO: 598 - protein, 12 aa, Artificial Sequence
  Description of Artificial Sequence: Synthetic peptide
GASTLQSGVPSR

SEQ ID NO: 599 - protein, 10 aa, Artificial Sequence
  Description of Artificial Sequence: Synthetic peptide
ASGNSFSNHD

SEQ ID NO: 600 - protein, 17 aa, Artificial Sequence
  Description of Artificial Sequence: Synthetic peptide
MSHEGDKTGLAQKFQGR

SEQ ID NO: 601 - protein, 30 aa, Artificial Sequence
  Description of Artificial Sequence: Synthetic polypeptide
GSKHRLRDYFLYNEYGPNYEEWGDYLATLD

SEQ ID NO: 602 - protein, 13 aa, Artificial Sequence
  Description of Artificial Sequence: Synthetic peptide
CSHSLQHSTGANY

SEQ ID NO: 603 - protein, 12 aa, Artificial Sequence
  Description of Artificial Sequence: Synthetic peptide
LATHRASGVPDR

SEQ ID NO: 604 - protein, 10 aa, Artificial Sequence
  Description of Artificial Sequence: Synthetic peptide
ASGNTFSKYD

SEQ ID NO: 605 - protein, 17 aa, Artificial Sequence
  Description of Artificial Sequence: Synthetic peptide
ISHERDKTESAQRFKGR

SEQ ID NO: 606 - protein, 31 aa, Artificial Sequence
  Description of Artificial Sequence: Synthetic polypeptide
GSKHRLRDYVLYDDYGLINYQEWNDYLEFLD

SEQ ID NO: 607 - protein, 13 aa, Artificial Sequence
  Description of Artificial Sequence: Synthetic peptide
STQSLRHSNGANY

SEQ ID NO: 608 - protein, 12 aa, Artificial Sequence
  Description of Artificial Sequence: Synthetic peptide
LGSQRASGVPDR

SEQ ID NO: 609 - protein, 17 aa, Artificial Sequence
  Description of Artificial Sequence: Synthetic peptide
MSHEGDKTESAQRFKGR

SEQ ID NO: 610 - protein, 10 aa, Artificial Sequence
  Description of Artificial Sequence: Synthetic peptide
ASGNTFRKYD

SEQ ID NO: 611 - protein, 31 aa, Artificial Sequence
  Description of Artificial Sequence: Synthetic polypeptide
GSKHRLRDYVLYDDYGLINQQEWNDYLEFLD

SEQ ID NO: 612 - protein, 10 aa, Artificial Sequence
  Description of Artificial Sequence: Synthetic peptide
VSDFPFSKYP

SEQ ID NO: 613 - protein, 17 aa, Artificial Sequence
  Description of Artificial Sequence: Synthetic peptide
ISGDAWHVVYSNSVQGR

SEQ ID NO: 614 - protein, 25 aa, Artificial Sequence
  Description of Artificial Sequence: Synthetic peptide
MFQESGPPRLDRWSGRNYYYYSGMD

SEQ ID NO: 615 - protein, 13 aa, Artificial Sequence
  Description of Artificial Sequence: Synthetic peptide
SSESLRQSNGKTS

SEQ ID NO: 616 - protein, 12 aa, Artificial Sequence
  Description of Artificial Sequence: Synthetic peptide
EVSNRFSGVSDR

SEQ ID NO: 617 - protein, 11 aa, Artificial Sequence
  Description of Artificial Sequence: Synthetic peptide
AYGVNTFGLYA

SEQ ID NO: 618 - protein, 15 aa, Artificial Sequence
  Description of Artificial Sequence: Synthetic peptide
IWRWKSSASHHFRGR

SEQ ID NO: 619 - protein, 19 aa, Artificial Sequence
  Description of Artificial Sequence: Synthetic peptide
TSTYDKWSGLHHDGVMAFS

SEQ ID NO: 620 - protein, 9 aa, Artificial Sequence
  Description of Artificial Sequence: Synthetic peptide
ASQSITGNW

SEQ ID NO: 621 - protein, 12 aa, Artificial Sequence
  Description of Artificial Sequence: Synthetic peptide
RGAALLGGVPSR

SEQ ID NO: 622 - protein, 132 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 623 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 624 - protein, 132 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSS

SEQ ID NO: 625 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSRPGTTATLTITSVEAGDEADYYCHIWDSRVPTKWVFGGGTTLTVL

SEQ ID NO: 626 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDFRPGTTATLTITSVEAGDEADYYCHIWDSRVPTKWVFGGGTTLTVL

SEQ ID NO: 627 - protein, 132 aa, Artificial Sequence
  Description of Artificial Sequence: Synthetic polypeptide
QMQLQESGPGLVKPSETLSLTCSVSGASISDSYWSWIRQPPGKGLEWIGYVHKSGDTNYSPSLKSRVNLSLDTSKNQVSLSLSAATAADSGVYYCARTLHGRRIYGIVAFNEWFTYFYMDVWGNGTQVTVSS

SEQ ID NO: 628 - protein, 105 aa, Artificial Sequence
  Description of Artificial Sequence: Synthetic polypeptide
SDISVAPGETARISCGEKSLGSRAVQWYQQRAGQAPSLIIYNNQDRPSGIPERFSGSPDSGFGTTATLTITSVEAGDEADYYCHIWDSRVPTKWVFGGGTTLTVL

SEQ ID NO: 629 - protein, 132 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSS

SEQ ID NO: 630 - protein, 108 aa, Artificial Sequence
  Description of Artificial Sequence: Synthetic polypeptide
SYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 631 - protein, 132 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVTISRDTSKNQFSLKLNSVTPADTAVYYCARARRGQRIYGVVSFGEFFYYYSMDVWGKGTTVTVSS

SEQ ID NO: 632 - protein, 108 aa, Artificial Sequence
  Description of Artificial Sequence: Synthetic polypeptide
SPVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 633 - protein, 132 aa, Artificial Sequence
  Description of Artificial Sequence: Synthetic polypeptide
QVQLQESGPGLVRPSETLSVTCIVSGGSISNYYWTWIRQSPGKGLEWIGYISDRETTTYNPSLNSRAVISRDTSKNQLSLQLRSVTTADTAIYFCATARRGQRIYGVVSFGEFFYYYYMDVWGKGTAVTVSS

SEQ ID NO: 634 - protein, 111 aa, Artificial Sequence
  Description of Artificial Sequence: Synthetic polypeptide
SVTSYVSPLSVALGETARISCGRQALGSRAVQWYQHKPGQAPILLIYNNQDRPSGIPERFSGTPDINFGTTATLTISGVEVGDEADYYCHMWDSRSGFSWSFGGATRLTVL

SEQ ID NO: 635 - protein, 132 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSS

SEQ ID NO: 636 - protein, 107 aa, Artificial Sequence
  Description of Artificial Sequence: Synthetic polypeptide
SLNPLSLAPGATAKIPCGERSRGSRAVQWYQQKPGQAPTLIIYNNQDRPAGVSERFSGNPDVAIGVTATLTISRVEVGDEGDYYCHYWDSRSPISWIFAGGTQLTVL

SEQ ID NO: 637 - protein, 132 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLRLKSVTAADSATYYCARAQQGKRIYGIVSFGEFFYYYYMDAWGKGTPVTVSS

SEQ ID NO: 638 - protein, 107 aa, Artificial Sequence
  Description of Artificial Sequence: Synthetic polypeptide
SLNPLSLAPGATAKIPCGERSRGSRAVQWYQQKPGQAPTLIIYNNQDRPAGVSERFSGNPDVAIGVTATLTISRVEVGDEADYYCHYWDSRSPISWIFGGGTQLTVL

SEQ ID NO: 639 - protein, 132 aa, Artificial Sequence
  Description of Artificial Sequence: Synthetic polypeptide
QVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSS

SEQ ID NO: 640 - protein, 105 aa, Artificial Sequence
  Description of Artificial Sequence: Synthetic polypeptide
TFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVL

SEQ ID NO: 641 - protein, 132 aa, Artificial Sequence
  Description of Artificial Sequence: Synthetic polypeptide
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSS

SEQ ID NO: 642 - protein, 105 aa, Artificial Sequence
  Description of Artificial Sequence: Synthetic polypeptide
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVL

SEQ ID NO: 643 - protein, 135 aa, Artificial Sequence
  Description of Artificial Sequence: Synthetic polypeptide
QSQLQESGPRLVEASETLSLTCNVSGESTGACTYFWGWVRQAPGKGLEWIGSLSHCQSFWGSGWTFHNPSLKSRLTISLDTPKNQVFLKLTSLTAADTATYYCARFDGEVLVYNHWPKPAWVDLWGRGIPVTVSS

SEQ ID NO: 644 - protein, 105 aa, Artificial Sequence
  Description of Artificial Sequence: Synthetic polypeptide
QSALTQPPSASGSPGQSITISCNGTATNFVSWYQQFPDKAPKLIIFGVDKRPPGVPDRFSGSRSGTTASLTVSRLQTDDEAVYYCGSLVGNWDVIFGGGTTLTVL

SEQ ID NO: 645 - protein, 135 aa, Artificial Sequence
  Description of Artificial Sequence: Synthetic polypeptide
QPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVSS

SEQ ID NO: 646 - protein, 105 aa, Artificial Sequence
  Description of Artificial Sequence: Synthetic polypeptide
QSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVL

SEQ ID NO: 647 - protein, 135 aa, Artificial Sequence
  Description of Artificial Sequence: Synthetic polypeptide
QPQLQESGPGLVEASETLSLTCTVSGDSTAACDYFWGWVRQPPGKGLEWIGSLSHCAGYYNSGWTYHNPSLKSRLTISLDTPKNQVFLKLNSVTAADTAIYYCARFGGDVLVYHDWPKPAWVDLWGRGVLVTVSS

SEQ ID NO: 648 - protein, 105 aa, Artificial Sequence
  Description of Artificial Sequence: Synthetic polypeptide
QSALTQPPSASGSPGQSITISCTGNINNFVSWYQQHPGKAPKLVIYGVNKRPSGVPDRFSGSKSGNAASLTVSGLQTDDEAVYYCGSLAGNWDVVFGGGTKLTVL

SEQ ID NO: 649 - protein, 135 aa, Artificial Sequence
  Description of Artificial Sequence: Synthetic polypeptide
QPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 650 - protein, 105 aa, Artificial Sequence
  Description of Artificial Sequence: Synthetic polypeptide
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVL

SEQ ID NO: 651 - protein, 135 aa, Artificial Sequence
  Description of Artificial Sequence: Synthetic polypeptide
QPQLQESGPGLVEASETLSLTCTVSGDSTAGCDYFWGWVRQPPGKGLEWIGGLSHCAGYYNTGWTYHNPSLKSRLTISLDTPKNQVFLKLNSVTAADTAIYYCARFDGEVLVYNDWPKPAWVDLWGRGTLVTVSS

SEQ ID NO: 652 - protein, 105 aa, Artificial Sequence
  Description of Artificial Sequence: Synthetic polypeptide
QSALTQPPSASGSPGQSITISCTGTSNNFVSWYQQHPAKAPKLVIYGVNKRPSGVPDRFSGSKSGNTASLTVSGLQTDDEAVYYCGSLVGNWDVIFGGGTKLTVL

SEQ ID NO: 653 - protein, 129 aa, Artificial Sequence
  Description of Artificial Sequence: Synthetic polypeptide
QVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSS

SEQ ID NO: 654 - protein, 110 aa, Artificial Sequence
  Description of Artificial Sequence: Synthetic polypeptide
QSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVL

SEQ ID NO: 655 - protein, 134 aa, Artificial Sequence
  Description of Artificial Sequence: Synthetic polypeptide
QLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSS

SEQ ID NO: 656 - protein, 107 aa, Artificial Sequence
  Description of Artificial Sequence: Synthetic polypeptide
EIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIK

SEQ ID NO: 657 - protein, 133 aa, Artificial Sequence
  Description of Artificial Sequence: Synthetic polypeptide
EVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSS

SEQ ID NO: 658 - protein, 107 aa, Artificial Sequence
  Description of Artificial Sequence: Synthetic polypeptide
EIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIK

SEQ ID NO: 659 - protein, 133 aa, Artificial Sequence [sequence omitted]

SEQ ID NO: 660 - protein, 107 aa, Artificial Sequence
  Description of Artificial Sequence: Synthetic polypeptide
EIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIK

SEQ ID NO: 661 - protein, 130 aa, Artificial Sequence
  Description of Artificial Sequence: Synthetic polypeptide
QVQLRESGPGLVKPSETLSLSCTVSQDSRPSDHSWTWVRQSPGKALEWIGDIHYNGATTYNPSLRSRVRIELDQSIPRFSLKMTSMTAADTGMYYCARNAIRIYGVVALGEWFHYGMDVWGQGTAVTVSS

SEQ ID NO: 662 - protein, 110 aa, Artificial Sequence
  Description of Artificial Sequence: Synthetic polypeptide
WASSELTQPPSVSVSPGQTARITCSGAPLTSRFTYWYRQKPGQAPVLIISRSSQRSSGWSGRFSASWSGTTVTLTIRGVQADDEADYYCQSSDTSDSYKMFGGGTKLTVL

SEQ ID NO: 663 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 664 - protein, 99 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLK

SEQ ID NO: 665 - protein, 123 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSS

SEQ ID NO: 666 - protein, 99 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFVVPGTRLDLK

SEQ ID NO: 667 - protein, 123 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSS

SEQ ID NO: 668 - protein, 99 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLK

SEQ ID NO: 669 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRGGAVSYARQLQGRVTMTRDMYSETAFLELRSLTSDDTAVYFCTRGKYCTARDYYNWDFEHWGQGTPVTVSS

SEQ ID NO: 670 - protein, 103 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 671 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS

SEQ ID NO: 672 - protein, 101 aa, Artificial Sequence
  Description of Artificial Sequence: Synthetic polypeptide
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 673 - protein, 121 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 674 - protein, 122 aa, Artificial Sequence [sequence omitted]

SEQ ID NO: 675 - protein, 103 aa, Artificial Sequence [sequence omitted]

SEQ ID NO: 676 - protein, 137 aa, Artificial Sequence
  Description of Artificial Sequence: Synthetic polypeptide
CQRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 677 - protein, 110 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL

SEQ ID NO: 678 - protein, 137 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 679 - protein, 110 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 680 - protein, 137 aa, Artificial Sequence
  Description of Artificial Sequence: Synthetic polypeptide
DGHLVQSGVEVKKTGATVKISCKVSGYSFIDYYLHWVQRAPGKGLEWVGLIDPENGEARYAEKFQGRVTIIADTSIDTGYMEMRSLKSEDTAVYFCAAGAVGADSGSWFDPWGQGTLVTVSSASTKGPSVFPLAPSS

SEQ ID NO: 681 - protein, 109 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVL

SEQ ID NO: 682 - protein, 139 aa, Artificial Sequence
  Description of Artificial Sequence: Synthetic polypeptide
QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSSASTKGPSVFPLAPSS

SEQ ID NO: 683 - protein, 107 aa, Artificial Sequence
  Description of Artificial Sequence: Synthetic polypeptide
DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIK

SEQ ID NO: 684 - protein, 140 aa, Artificial Sequence
  Description of Artificial Sequence: Synthetic polypeptide
QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSS

SEQ ID NO: 685 - protein, 112 aa, Artificial Sequence
  Description of Artificial Sequence: Synthetic polypeptide
EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIK

SEQ ID NO: 686 - protein, 141 aa, Artificial Sequence
  Description of Artificial Sequence: Synthetic polypeptide
QVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS

SEQ ID NO: 687 - protein, 112 aa, Artificial Sequence
  Description of Artificial Sequence: Synthetic polypeptide
DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK

SEQ ID NO: 688 - protein, 141 aa, Artificial Sequence
  Description of Artificial Sequence: Synthetic polypeptide
QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 689 - protein, 112 aa, Artificial Sequence
  Description of Artificial Sequence: Synthetic polypeptide
DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK

SEQ ID NO: 690 - protein, 141 aa, Artificial Sequence
  Description of Artificial Sequence: Synthetic polypeptide
QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS

SEQ ID NO: 691 - protein, 112 aa, Artificial Sequence
  Description of Artificial Sequence: Synthetic polypeptide
DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK

SEQ ID NO: 692 - protein, 135 aa, Artificial Sequence
  Description of Artificial Sequence: Synthetic polypeptide
RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSS

SEQ ID NO: 693 - protein, 111 aa, Artificial Sequence
  Description of Artificial Sequence: Synthetic polypeptide
DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDL

SEQ ID NO: 694 - protein, 132 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSA

SEQ ID NO: 695 - protein, 108 aa, Artificial Sequence
  Description of Artificial Sequence: Synthetic polypeptide
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVK

SEQ ID NO: 696 - protein, 232 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 697 - protein, 232 aa, Artificial Sequence
  Description of Artificial Sequence: Synthetic polypeptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 698 - protein, 232 aa, Artificial Sequence
  Description of Artificial Sequence: Synthetic polypeptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 699 - protein, 232 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 700 - protein, 232 aa, Artificial Sequence
  Description of Artificial Sequence: Synthetic polypeptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 701 - protein, 232 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 702 - protein, 228 aa, Artificial Sequence
  Description of Artificial Sequence: Synthetic polypeptide
SDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 703 - protein, 232 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 704 - protein, 232 aa, Artificial Sequence
  Description of Artificial Sequence: Synthetic polypeptide
EPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 705 - protein, 228 aa, Artificial Sequence
  Description of Artificial Sequence: Synthetic polypeptide
SDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 706 - protein, 228 aa, Artificial Sequence
  Description of Artificial Sequence: Synthetic polypeptide
SDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 707 - protein, 228 aa, Artificial Sequence
  Description of Artificial Sequence: Synthetic polypeptide
SDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 708 - protein, 228 aa, Artificial Sequence
  Description of Artificial Sequence: Synthetic polypeptide
SDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 709 - protein, 232 aa, Artificial Sequence
  Description of Artificial Sequence: Synthetic polypeptide
EPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 710 - protein, 232 aa, Artificial Sequence
  Description of Artificial Sequence: Synthetic polypeptide
EPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 711 - protein, 16 aa, Artificial Sequence
  Description of Artificial Sequence: Synthetic peptide
GGGSGGGSGGGSGGGS

SEQ ID NO: 712 - protein, 20 aa, Artificial Sequence
  Description of Artificial Sequence: Synthetic peptide
  MISC_FEATURE (1)..(20): This sequence may encompass 3-4 "Gly Gly Gly Gly Ser" repeating units
GGGGSGGGGSGGGGSGGGGS

SEQ ID NO: 713 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 714 - protein, 110 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLG

SEQ ID NO: 715 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNSLYLQMNSLKTEDTAMYYCVRHGNFGNSYVSWFAVWGQGTLVTVSS

SEQ ID NO: 716 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNSLYLQMNSLRTEDTAVYYCVRHGNFGHSYVSWFAVWGQGTLVTVSS

SEQ ID NO: 717 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDNSKNTLYLQMNSLRAEDTAVYYCVRHGNFGHSYVSWFAVWGQGTLVTVSS

SEQ ID NO: 718 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDNSKNTLYLQMNSLRAEDTAMYYCVRHGNFGNSYVSWFAVWGQGTLVTVSS

SEQ ID NO: 719 - protein, 125 aa, Artificial Sequence
  Description of Artificial Sequence: Synthetic polypeptide
EVQLVESGGGLVQPGGSLRLSCAASGFTFSDYAMNWVRQAPGKGLEWVGRTRSKYNNYATYYAASVKGRFTISRDDSKNSLYLQMNSLKTEDTAVYYCVRHGNFGNSYVSWFAVWGQGTLVTVSS

SEQ ID NO: 720 - protein, 125 aa, Artificial Sequence
  Description of Artificial Sequence: Synthetic polypeptide
EVQLVESGGGLVQPGGSLRLSCAASGFTFSDYAMNWVRQAPGKGLEWVGRTRSKYNNYATYYAASVKGRFTISRDDSKNSLYLQMNSLKTEDTAVYYCVRHGNFGHSYVSWFAVWGQGTLVTVSS

SEQ ID NO: 721 - protein, 125 aa, Artificial Sequence
  Description of Artificial Sequence: Synthetic polypeptide
EVQLVESGGGLVQPGGSLRLSCAASGFTFSDYAMNWVRQAPGKGLEWVGRTRSKYNSYATYYAASVKGRFTISRDDSKNSLYLQMNSLKTEDTAVYYCVRHGNFGNSYVSWFAVWGQGTLVTVSS

SEQ ID NO: 722 - protein, 125 aa, Artificial Sequence
  Description of Artificial Sequence: Synthetic polypeptide
EVQLVESGGGLVQPGGSLRLSCAASGFTFSDYAMNWVRQAPGKGLEWVGRTRSKYNSYATYYAASVKGRFTISRDDSKNSLYLQMNSLKTEDTAVYYCVRHGNFGHSYVSWFAVWGQGTLVTVSS

SEQ ID NO: 723 - protein, 109 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLIGDKAALTLSGAQPEDEAEYYCALWYSNLWVFGGGTKLTVL

SEQ ID NO: 724 - protein, 109 aa, Artificial Sequence
  Description of Artificial Sequence: Synthetic polypeptide
QAVVTQEPSLTVSPGGTVTLTCGSSTGAVTTSNYANWVQQKPGQAPRGLIGGTSNRAPWTPARFSGSLLGGKAALTLSGAQPEDEAEYYCALWYSNLWVFGGGTKLTVL

SEQ ID NO: 725 - protein, 109 aa, Artificial Sequence
  Description of Artificial Sequence: Synthetic polypeptide
QAVVTQEPSLTVSPGGTVTLTCGSSTGAVTTSHYANWVQQKPGQAPRGLIGGTSKRAPWTPARFSGSLLGGKAALTLSGAQPEDEAEYYCALWYSALWVFGGGTKLTVL

SEQ ID NO: 726 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTSNRAPWTPARFSGSLLGGKAALTLSGAQPEDEAEYYCALWYSARWVFGGGTKLTVL

SEQ ID NO: 727 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTSNRAPGVPARFSGSLSGGKAALTISGAQPEDEAEYYCALWYSARWVFGGGTKLTVL

SEQ ID NO: 728 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNSLYLQMNSLRTEDTAVYYCVRHGNFGHSYVSWFAYWGQGTLVTVSS

SEQ ID NO: 729 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVARIRSKYNNYATYYAASVKGRFTISRDDSKNSLYLQMNSLRTEDTAVYYCVRHGNFGHSYVSWFAYWGQGTLVTVSS

SEQ ID NO: 730 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNTLYLQMNSLRTEDTAVYYCVRHGNFGHSYVSWFAYWGQGTLVTVSS

SEQ ID NO: 731 - protein, 109 aa, Artificial Sequence
  Description of Artificial Sequence: Synthetic polypeptide
QAVVTQEPSLTVSPGGTVTLTCRSSTGAVTTGHYANWVQQKPGQAPRGLIGGTNKRAPGVPARFSGSLLGGKAALTISGAQPEDEAEYYCALWYSNLWVFGGGTKLTVL

SEQ ID NO: 732 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTNKRAPGVPARFSGSLSGGKAALTISGAQPEDEAEYYCALWYSNLWVFGGGTKLTVL

SEQ ID NO: 733 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTNKRAPGVPARFSGSLSGGKAALTISGAQPEDEAEYYCALWYSNRWVFGGGTKLTVL

SEQ ID NO: 734 - protein, 125 aa, Artificial Sequence
  Description of Artificial Sequence: Synthetic polypeptide
EVQLVESGGGLVQPGGSLRLSCAASGFTFNDYAMNWVRQAPGKGLEWVGRTRSKYNNYATYYAASVKGRFTISRDDSKNSLYLQMNSLKTEDTAMYYCVRHGNFGHSYVSWFAYWGQGTLVTVSS

SEQ ID NO: 735 - protein, 125 aa, Artificial Sequence
  Description of Artificial Sequence: Synthetic polypeptide
EVQLVESGGGLVQPGGSLRLSCAASGFTFNDYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSS

SEQ ID NO: 736 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRTRSKYNNYATYYAASVKGRFTISRDDSKNSLYLQMNSLKTEDTAMYYCVRHGNFGHSYVSWFAYWGQGTLVTVSS

SEQ ID NO: 737 - protein, 125 aa, Artificial Sequence
  Description of Artificial Sequence: Synthetic polypeptide
EVQLVESGGGLVQPGGSLRLSCAASGFTFNDYAMNWVRQAPGKGLEWVGRTRSKYNNYATYYADSVKGRFTISRDDSKNSLYLQMNSLRTEDTAVYYCVRHGNFGHSYVSWFAYWGQGTLVTVSS

SEQ ID NO: 738 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTNKRAPGVPARFSGSLLGGKAALTLSGAQPEDEAEYYCALWYSNLWVFGGGTKLTVL

SEQ ID NO: 739 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTNKRAPWTPARFSGSLSGGKAALTISGAQPEDEAEYYCALWYSNRWVFGGGTKLTVL

SEQ ID NO: 740 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTSNRAPGVPARFSGSLSGGKAALTISGAQPEDEAEYYCALWYSNRWVFGGGTKLTVL

SEQ ID NO: 741 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTNKRAPGVPARFSGSLSGGKAALTISGAQPEDEAEYYCALWYSARWVFGGGTKLTVL

SEQ ID NO: 742 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTSNRAPWTPARFSGSLSGGKAALTISGAQPEDEAEYYCALWYSNRWVFGGGTKLTVL

SEQ ID NO: 743 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTNKRAPWTPARFSGSLSGGKAALTISGAQPEDEAEYYCALWYSARWVFGGGTKLTVL

SEQ ID NO: 744 - protein, 109 aa, Artificial Sequence
  Description of Artificial Sequence: Synthetic polypeptide
QAVVTQPPSLTVSPGGTVTLTCGSSTGAVTTGHYANWVQQKPGQAPRGLIGGTSNRAPWTPARFSGSLSGGKAALTISGAQPEDEAEYYCALWYSARWVFGGGTKLTVL

SEQ ID NO: 745 - protein, 109 aa, Artificial Sequence
  Description of Artificial Sequence: Synthetic polypeptide
QAVVTQEPSLTVSPGGTVTLTCGSSTGAVTTGHYANWVQQKPGQAPRGLIGGTNKRAPGVPARFSGSLLGGKAALTISGAQPEDEAEYYCALWYSARWVFGGGTKLTVL

SEQ ID NO: 746 - protein, 99 aa, Unknown
  Description of Unknown: EC domain of CD4 sequence
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVG

SEQ ID NO: 747 - protein, 203 aa, Unknown
  Description of Unknown: EC domain of CD4 sequence
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVG

SEQ ID NO: 748 - protein, 99 aa, Unknown
  Description of Unknown: EC domain of CD4 sequence
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFG

SEQ ID NO: 749 - protein, 203 aa, Unknown
  Description of Unknown: EC domain of CD4 sequence
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGGGGSGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFG

SEQ ID NO: 750 - protein, 20 aa, Artificial Sequence
  Description of Artificial Sequence: Synthetic peptide
GGGGSGGGGSGGGGSGGGGS

SEQ ID NO: 751 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 752 - protein, 455 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 753 - protein, 215 aa, Artificial Sequence
  Description of Artificial Sequence: Synthetic polypeptide
QAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 754 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 755 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 756 - protein, 455 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 757 - protein, 455 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 758 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 759 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 760 - protein, 455 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 761 - protein, 215 aa, Artificial Sequence
  Description of Artificial Sequence: Synthetic polypeptide
QAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 762 - protein, 328 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 763 - protein, 455 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYAAYYADSVKSRFTISRDDSKNSLYLQMNSLRTEDTAVYYCVRHGNFGHSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 764 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 765 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 766 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 767 - protein, 455 aa, Artificial Sequence; identical to SEQ ID NO: 756
  Description of Artificial Sequence: Synthetic polypeptide

SEQ ID NO: 768 - protein, 455 aa, Artificial Sequence; identical to SEQ ID NO: 757
  Description of Artificial Sequence: Synthetic polypeptide

SEQ ID NO: 769 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 770 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 771 - protein, 455 aa, Artificial Sequence; identical to SEQ ID NO: 760
  Description of Artificial Sequence: Synthetic polypeptide

SEQ ID NO: 772 - protein, 432 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 773 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 774 - protein, 486 aa, Artificial Sequence; identical to SEQ ID NO: 773
  Description of Artificial Sequence: Synthetic polypeptide

SEQ ID NO: 775 - protein, 436 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 776 - protein, 212 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 777 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 778 - protein, 436 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 779 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 780 - protein, 436 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 781 - protein, 436 aa, Artificial Sequence
  Description of Artificial Sequence: Synthetic polypeptide
KKVVYGKKGDTVELTCTASQKKNIQFHWKNSNQIKILGNQGSFLTKGPSKLNDRVDSRRSLWDQGNFPLIIKNLKPEDSDTYICEVEDQKEEVQLVVVGGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 782 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 783 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 784 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 785 - protein, 455 aa, Artificial Sequence; identical to SEQ ID NO: 756
  Description of Artificial Sequence: Synthetic polypeptide

SEQ ID NO: 786 - protein, 455 aa, Artificial Sequence; identical to SEQ ID NO: 757
  Description of Artificial Sequence: Synthetic polypeptide

SEQ ID NO: 787 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 788 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 789 - protein, 455 aa, Artificial Sequence; identical to SEQ ID NO: 760
  Description of Artificial Sequence: Synthetic polypeptide

SEQ ID NO: 790 - protein, 407 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 791 - protein, 486 aa, Artificial Sequence; identical to SEQ ID NO: 773
  Description of Artificial Sequence: Synthetic polypeptide

SEQ ID NO: 792 - protein, 486 aa, Artificial Sequence; identical to SEQ ID NO: 773
  Description of Artificial Sequence: Synthetic polypeptide

SEQ ID NO: 793 - protein, 515 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 794 - protein, 291 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGGGSGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 795 - protein, 486 aa, Artificial Sequence; identical to SEQ ID NO: 777
  Description of Artificial Sequence: Synthetic polypeptide

SEQ ID NO: 796 - protein, 515 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 797 - protein, 486 aa, Artificial Sequence; identical to SEQ ID NO: 779
  Description of Artificial Sequence: Synthetic polypeptide

SEQ ID NO: 798 - protein, 515 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 799 - protein, 515 aa, Artificial Sequence
  Description of Artificial Sequence: Synthetic polypeptide
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAGGGSGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 800 - protein, 486 aa, Artificial Sequence; identical to SEQ ID NO: 777
  Description of Artificial Sequence: Synthetic polypeptide

SEQ ID NO: 801 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 802 - protein, 206 aa, Artificial Sequence
  Description of Artificial Sequence: Synthetic polypeptide
DIQMTQSPSSLSASVGDTATITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 803 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 804 - protein, 486 aa, Artificial Sequence; identical to SEQ ID NO: 779
  Description of Artificial Sequence: Synthetic polypeptide

SEQ ID NO: 805 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 806 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 807 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 808 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKSRFTISRDDSKNSLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 809 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 810 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 811 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 812 - protein, 486 aa, Artificial Sequence; identical to SEQ ID NO: 773
  Description of Artificial Sequence: Synthetic polypeptide

SEQ ID NO: 813 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 814 - protein, 453 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASFDFDTFSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 815 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 816 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 817 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 818 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 819 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 820 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNSLYLQMNSLRTEDTAVYYCVRHGNFGHSYVSWFAVWGQGTLVTVSSGGGGSGGGGSGGGGSGGGGSQAVVTQEPSLTVSPGGTVTLTCGSSTGAVTTSNYANWVQQKPGQAPRGLIGGTSNRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 821 - protein, 486 aa, Artificial Sequence; identical to SEQ ID NO: 777
  Description of Artificial Sequence: Synthetic polypeptide

SEQ ID NO: 822 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 823 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDFRPGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 824 - protein, 486 aa, Artificial Sequence; identical to SEQ ID NO: 777
  Description of Artificial Sequence: Synthetic polypeptide

SEQ ID NO: 825 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 826 - protein, 486 aa, Artificial Sequence; identical to SEQ ID NO: 779
  Description of Artificial Sequence: Synthetic polypeptide

SEQ ID NO: 827 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 828 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 829 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 830 - protein, 486 aa, Artificial Sequence; identical to SEQ ID NO: 806
  Description of Artificial Sequence: Synthetic polypeptide

SEQ ID NO: 831 - protein, 486 aa, Artificial Sequence; identical to SEQ ID NO: 807
  Description of Artificial Sequence: Synthetic polypeptide

SEQ ID NO: 832 - protein, 486 aa, Artificial Sequence; identical to SEQ ID NO: 808
  Description of Artificial Sequence: Synthetic polypeptide

SEQ ID NO: 833 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 834 - protein, 486 aa, Artificial Sequence; identical to SEQ ID NO: 813
  Description of Artificial Sequence: Synthetic polypeptide

SEQ ID NO: 835 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 836 - protein, 486 aa, Artificial Sequence; identical to SEQ ID NO: 773
  Description of Artificial Sequence: Synthetic polypeptide

SEQ ID NO: 837 - protein, 486 aa, Artificial Sequence; identical to SEQ ID NO: 773
  Description of Artificial Sequence: Synthetic polypeptide

SEQ ID NO: 838 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 839 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGNSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 840 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYNPSLKSRVHLSLDTSKNQVSLSLTGVTAADSGKYYCARTLHGRRIYGIVAFNEWFTYFYMDVWGTGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 841 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 842 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 843 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTSHYANWVQQKPGQAPRGLIGGTSKRAPWTPARFSGSLLGGKAALTLSGAQPEDEAEYYCALWYSALWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 844 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNSLYLQMNSLRTEDTAVYYCVRHGNFGHSYVSWFAYWGQGTLVTVSSGGGGSGGGGSGGGGSGGGGSQAVVTQPPSLTVSPGGTVTLTCGSSTGAVTTGHYANWVQQKPGQAPRGLIGGTSNRAPGVPARFSGSLSGGKAALTISGAQPEDEAEYYCALWYSARWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 845 - protein, 486 aa, Artificial Sequence
  Description of Artificial Sequence: Synthetic polypeptide
EVQLVESGGGLVQPGGSLRLSCAASGFTFSDYAMNWVRQAPGKGLEWVGRTRSKYNNYATYYAASVKGRFTISRDDSKNSLYLQMNSLKTEDTAVYYCVRHGNFGHSYVSWFAVWGQGTLVTVSSGGGGSGGGGSGGGGSGGGGSQAVVTQEPSLTVSPGGTVTLTCGSSTGAVTTGHYANWVQQKPGQAPRGLIGGTNKRAPWTPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 846 - protein, 486 aa, Artificial Sequence; identical to SEQ ID NO: 819
  Description of Artificial Sequence: Synthetic polypeptide

SEQ ID NO: 847 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNTLYLQMNSLRTEDTAVYYCVRHGNFGHSYVSWFAYWGQGTLVTVSSGGGGSGGGGSGGGGSGGGGSQAVVTQPPSLTVSPGGTVTLTCGSSTGAVTTGHYANWVQQKPGQAPRGLIGGTNKRAPGVPARFSGSLSGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 848 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNTLYLQMNSLRTEDTAVYYCVRHGNFGHSYVSWFAYWGQGTLVTVSSGGGGSGGGGSGGGGSGGGGSQAVVTQPPSLTVSPGGTVTLTCGSSTGAVTTGHYANWVQQKPGQAPRGLIGGTNKRAPGVPARFSGSLSGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 849 - protein, 486 aa, Artificial Sequence
  Description of Artificial Sequence: Synthetic polypeptide
EVQLVESGGGLVQPGGSLSLSCAASGFTFSTYAMNWVRQAPGKGLEWVGRIRSKYNNYATYYAASVKGRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 850 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKGRFTISRDDSKNTLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 851 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYAAYYAASVKSRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 852 - protein, 486 aa, Artificial Sequence
  Description of Artificial Sequence: Synthetic polypeptide
EVQLVESGGGLVQPGGSLSLSCAASGFTFSTYAMNWVRQAPGKGLEWVGRIRSKYNNYAAYYAASVKGRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 853 - protein, 486 aa, Artificial Sequence
  Description of Artificial Sequence: Synthetic polypeptide
EVQLVESGGGLVQPGGSLSLSCAASGFTFSTYAMNWVRQAPGKGLEWVGRIRSKYNNYAEYYAASVKGRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 854 - protein, 486 aa, Artificial Sequence
  Description of Artificial Sequence: Synthetic polypeptide
EVQLVESGGGLVQPGGSLSLSCAASGFTFSTYAMNWVRQAPGKGLEWVGRIRSKYNNYATYYAASVKSRFTISRDDSKNTLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 855 - protein, 486 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYAASVKSRFTISRDDSKNTLYLEMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 856 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQPPSLTVSPGGTVTLTCGSSTGAVTTGHYANWVQQKPGQAPRGLIGGTNKRAPGVPARFSGSLSGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 857 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTNKRAPGVPARFSGSLLGGKAALTLSGAQPEDEAEYYCALWYSNLWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 858 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYAASVKGRFTISRDDSKNSLYLQMNSLKTEDTAMYYCVRHGNFGHSYVSWFAYWGQGTLVTVSSGGGGSGGGGSGGGGSGGGGSQAVVTQPPSLTVSPGGTVTLTCGSSTGAVTTGHYANWVQQKPGQAPRGLIGGTNKRAPWTPARFSGSLSGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 859 - protein, 486 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYAAYYADSVKSRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 860 - protein, 486 aa, Artificial Sequence
  Description of Artificial Sequence: Synthetic polypeptide
EVQLVESGGGLVQPGGSLSLSCAASGFTFNTYAMNWVRQAPGKGLEWVGRIRSKYNNYATYYADSVKSRFTISRDDSKNSLYLQMNSLRTEDTAVYYCVRHGNFGHSYVSWFAYWGQGTLVTVSSGGGGSGGGGSGGGGSGGGGSQAVVTQEPSLTVSPGGTVTLTCGSSTGAVTTGHYANWVQQKPGQAPRGLIGGTSNRAPGVPARFSGSLLGGKAALTISGAQPEDEAEYYCALWYSNRWVFGGGTKLTVLEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 861 - protein, 486 aa, Artificial Sequence; identical to SEQ ID NO: 777
  Description of Artificial Sequence: Synthetic polypeptide

SEQ ID NO: 862 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 863 - protein, 214 aa, Artificial Sequence
  Description of Artificial Sequence: Synthetic polypeptide
SYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 864 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 865 - protein, 486 aa, Artificial Sequence; identical to SEQ ID NO: 779
  Description of Artificial Sequence: Synthetic polypeptide

SEQ ID NO: 866 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 867 - protein, 486 aa, Artificial Sequence; identical to SEQ ID NO: 828
  Description of Artificial Sequence: Synthetic polypeptide

SEQ ID NO: 868 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 869 - protein, 486 aa, Artificial Sequence; identical to SEQ ID NO: 806
  Description of Artificial Sequence: Synthetic polypeptide

SEQ ID NO: 870 - protein, 486 aa, Artificial Sequence; identical to SEQ ID NO: 807
  Description of Artificial Sequence: Synthetic polypeptide

SEQ ID NO: 871 - protein, 486 aa, Artificial Sequence; identical to SEQ ID NO: 808
  Description of Artificial Sequence: Synthetic polypeptide

SEQ ID NO: 872 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 873 - protein, 486 aa, Artificial Sequence; identical to SEQ ID NO: 811
  Description of Artificial Sequence: Synthetic polypeptide

SEQ ID NO: 874 - protein, 486 aa, Artificial Sequence; identical to SEQ ID NO: 813
  Description of Artificial Sequence: Synthetic polypeptide

SEQ ID NO: 875 - protein, 486 aa, Artificial Sequence; identical to SEQ ID NO: 773
  Description of Artificial Sequence: Synthetic polypeptide

SEQ ID NO: 876 - protein, 462 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 877 - protein, 486 aa, Artificial Sequence; identical to SEQ ID NO: 815
  Description of Artificial Sequence: Synthetic polypeptide

SEQ ID NO: 878 - protein, 486 aa, Artificial Sequence; identical to SEQ ID NO: 816
  Description of Artificial Sequence: Synthetic polypeptide

SEQ ID NO: 879 - protein, 486 aa, Artificial Sequence; identical to SEQ ID NO: 817
  Description of Artificial Sequence: Synthetic polypeptide

SEQ ID NO: 880 - protein, 486 aa, Artificial Sequence; identical to SEQ ID NO: 818
  Description of Artificial Sequence: Synthetic polypeptide

SEQ ID NO: 881 - protein, 486 aa, Artificial Sequence; identical to SEQ ID NO: 777
  Description of Artificial Sequence: Synthetic polypeptide

SEQ ID NO: 882 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 883 - protein, 213 aa, Artificial Sequence
  Description of Artificial Sequence: Synthetic polypeptide
SLNPLSLAPGATAKIPCGERSRGSRAVQWYQQKPGQAPTLIIYNNQDRPAGVSERFSGNPDVAIGVTATLTISRVEVGDEGDYYCHYWDSRSPISWIFAGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 884 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 885 - protein, 486 aa, Artificial Sequence; identical to SEQ ID NO: 779
  Description of Artificial Sequence: Synthetic polypeptide

SEQ ID NO: 886 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 887 - protein, 486 aa, Artificial Sequence; identical to SEQ ID NO: 828
  Description of Artificial Sequence: Synthetic polypeptide

SEQ ID NO: 888 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 889 - protein, 486 aa, Artificial Sequence; identical to SEQ ID NO: 806
  Description of Artificial Sequence: Synthetic polypeptide

SEQ ID NO: 890 - protein, 486 aa, Artificial Sequence; identical to SEQ ID NO: 807
  Description of Artificial Sequence: Synthetic polypeptide

SEQ ID NO: 891 - protein, 486 aa, Artificial Sequence; identical to SEQ ID NO: 808
  Description of Artificial Sequence: Synthetic polypeptide

SEQ ID NO: 892 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 893 - protein, 486 aa, Artificial Sequence; identical to SEQ ID NO: 811
  Description of Artificial Sequence: Synthetic polypeptide

SEQ ID NO: 894 - protein, 486 aa, Artificial Sequence; identical to SEQ ID NO: 813
  Description of Artificial Sequence: Synthetic polypeptide

SEQ ID NO: 895 - protein, 486 aa, Artificial Sequence; identical to SEQ ID NO: 773
  Description of Artificial Sequence: Synthetic polypeptide

SEQ ID NO: 896 - protein, 462 aa, Artificial Sequence
  Description of Artificial Sequence: Synthetic polypeptide
QVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVLHEALHSHYTQKSLSLSPGK

SEQ ID NO: 897 - protein, 486 aa, Artificial Sequence; identical to SEQ ID NO: 815
  Description of Artificial Sequence: Synthetic polypeptide

SEQ ID NO: 898 - protein, 486 aa, Artificial Sequence; identical to SEQ ID NO: 816
  Description of Artificial Sequence: Synthetic polypeptide

SEQ ID NO: 899 - protein, 486 aa, Artificial Sequence; identical to SEQ ID NO: 817
  Description of Artificial Sequence: Synthetic polypeptide

SEQ ID NO: 900 - protein, 486 aa, Artificial Sequence; identical to SEQ ID NO: 818
  Description of Artificial Sequence: Synthetic polypeptide

SEQ ID NO: 901 - protein, 455 aa, Artificial Sequence
  Description of Artificial Sequence: Synthetic polypeptide
EVQLVESGGGLVQPGGSLSLSCAASGFTFNTYAMNWVRQAPGKGLEWVGRIRSKYNNYATYYADSVKSRFTISRDDSKNSLYLQMNSLRTEDTAVYYCVRHGNFGHSYVSWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 902 - protein, 11 aa, Artificial Sequence
  Description of Artificial Sequence: Synthetic peptide
DDDTFTKYWTH

SEQ ID NO: 903 - protein, 17 aa, Artificial Sequence
  Description of Artificial Sequence: Synthetic peptide
VISPHFARPIYSYKFRD

SEQ ID NO: 904 - protein, 16 aa, Artificial Sequence
  Description of Artificial Sequence: Synthetic peptide
DPFGDRAPHYNYHMDV

SEQ ID NO: 905 - protein, 12 aa, Artificial Sequence
  Description of Artificial Sequence: Synthetic peptide
RASQGLDSSHLA

SEQ ID NO: 906 - protein, 7 aa, Artificial Sequence
  Description of Artificial Sequence: Synthetic peptide
GTSNRAR

SEQ ID NO: 907 - protein, 9 aa, Artificial Sequence
  Description of Artificial Sequence: Synthetic peptide
QRYGGTPIT

SEQ ID NO: 908 - protein, 6 aa, Artificial Sequence
  Description of Artificial Sequence: Synthetic peptide
RTELIH

SEQ ID NO: 909 - protein, 17 aa, Artificial Sequence
  Description of Artificial Sequence: Synthetic peptide
WVKTVTGAVNFGSPDFR

SEQ ID NO: 910 - protein, 14 aa, Artificial Sequence
  Description of Artificial Sequence: Synthetic peptide
QKFYTGGQGWYFDL

SEQ ID NO: 911 - protein, 9 aa, Artificial Sequence
  Description of Artificial Sequence: Synthetic peptide
TAASYGHMT

SEQ ID NO: 912 - protein, 7 aa, Artificial Sequence
  Description of Artificial Sequence: Synthetic peptide
ATSKRAS

SEQ ID NO: 913 - protein, 5 aa, Artificial Sequence
  Description of Artificial Sequence: Synthetic peptide
QQLEF

SEQ ID NO: 914 - protein, 5 aa, Artificial Sequence
  Description of Artificial Sequence: Synthetic peptide
GYGMH

SEQ ID NO: 915 - protein, 17 aa, Artificial Sequence
  Description of Artificial Sequence: Synthetic peptide
SISHDGIKKYHAEKVWG

SEQ ID NO: 916 - protein, 36 aa, Artificial Sequence
  Description of Artificial Sequence: Synthetic polypeptide
DLREDECEEWWSDYYDFGKQLPCAKSRGGLVGIADN

SEQ ID NO: 917 - protein, 13 aa, Artificial Sequence
  Description of Artificial Sequence: Synthetic peptide
SGNTSNIGNNFVS

SEQ ID NO: 918 - protein, 7 aa, Artificial Sequence
  Description of Artificial Sequence: Synthetic peptide
ETDKRPS

SEQ ID NO: 919 - protein, 12 aa, Artificial Sequence
  Description of Artificial Sequence: Synthetic peptide
ATWAASLSSARV

SEQ ID NO: 920 - protein, 7 aa, Artificial Sequence
  Description of Artificial Sequence: Synthetic peptide
NDNYYWA

SEQ ID NO: 921 - protein, 16 aa, Artificial Sequence
  Description of Artificial Sequence: Synthetic peptide
TIYYSGTTYYNPSLRN

SEQ ID NO: 922 - protein, 18 aa, Artificial Sequence
  Description of Artificial Sequence: Synthetic peptide
MPSHGFWSTSFSYWYFDL

SEQ ID NO: 923 - protein, 11 aa, Artificial Sequence
  Description of Artificial Sequence: Synthetic peptide
RASQSVTKYLN

SEQ ID NO: 924 - protein, 7 aa, Artificial Sequence
  Description of Artificial Sequence: Synthetic peptide
GTYTLLS

SEQ ID NO: 925 - protein, 9 aa, Artificial Sequence
  Description of Artificial Sequence: Synthetic peptide
QQAHSTPWT

SEQ ID NO: 926 - protein, 13 aa, Artificial Sequence
  Description of Artificial Sequence: Synthetic peptide
DDPYTDDDTFTKY

SEQ ID NO: 927 - protein, 4 aa, Artificial Sequence
  Description of Artificial Sequence: Synthetic peptide
PHFA

SEQ ID NO: 928 - protein, 14 aa, Artificial Sequence
  Description of Artificial Sequence: Synthetic peptide
PFGDRAPHYNYHMD

SEQ ID NO: 929 - protein, 8 aa, Artificial Sequence
  Description of Artificial Sequence: Synthetic peptide
SQGLDSSH

SEQ ID NO: 930 - protein, 3 aa, Artificial Sequence
  Description of Artificial Sequence: Synthetic peptide
GTS

SEQ ID NO: 931 - protein, 6 aa, Artificial Sequence
  Description of Artificial Sequence: Synthetic peptide
YGGTPI

SEQ ID NO: 932 - protein, 8 aa, Artificial Sequence
  Description of Artificial Sequence: Synthetic peptide
EDIFERTE

SEQ ID NO: 933 - protein, 4 aa, Artificial Sequence
  Description of Artificial Sequence: Synthetic peptide
TVTG

SEQ ID NO: 934 - protein, 12 aa, Artificial Sequence
  Description of Artificial Sequence: Synthetic peptide
KFYTGGQGWYFD

SEQ ID NO: 935 - protein, 5 aa, Artificial Sequence
  Description of Artificial Sequence: Synthetic peptide
ASYGH

SEQ ID NO: 936 - protein, 3 aa, Artificial Sequence
  Description of Artificial Sequence: Synthetic peptide
ATS

SEQ ID NO: 937 - protein, 2 aa, Artificial Sequence
  Description of Artificial Sequence: Synthetic peptide
LE

SEQ ID NO: 938 - protein, 7 aa, Artificial Sequence
  Description of Artificial Sequence: Synthetic peptide
QFRFDGY

SEQ ID NO: 939 - protein, 4 aa, Artificial Sequence
  Description of Artificial Sequence: Synthetic peptide
HDGI

SEQ ID NO: 940 - protein, 34 aa, Artificial Sequence
  Description of Artificial Sequence: Synthetic polypeptide
LREDECEEWWSDYYDFGKQLPCAKSRGGLVGIAD

SEQ ID NO: 941 - protein, 10 aa, Artificial Sequence
  Description of Artificial Sequence: Synthetic peptide
GNTSNIGNNF

SEQ ID NO: 942 - protein, 3 aa, Artificial Sequence
  Description of Artificial Sequence: Synthetic peptide
ETD

SEQ ID NO: 943 - protein, 9 aa, Artificial Sequence
  Description of Artificial Sequence: Synthetic peptide
WAASLSSAR

SEQ ID NO: 944 - protein, 9 aa, Artificial Sequence
  Description of Artificial Sequence: Synthetic peptide
GDSVSNDNY

SEQ ID NO: 945 - protein, 3 aa, Artificial Sequence
  Description of Artificial Sequence: Synthetic peptide
YSG

SEQ ID NO: 946 - protein, 16 aa, Artificial Sequence
  Description of Artificial Sequence: Synthetic peptide
PSHGFWSTSFSYWYFD

SEQ ID NO: 947 - protein, 7 aa, Artificial Sequence
  Description of Artificial Sequence: Synthetic peptide
SQSVTKY

SEQ ID NO: 948 - protein, 3 aa, Artificial Sequence
  Description of Artificial Sequence: Synthetic peptide
GTY

SEQ ID NO: 949 - protein, 6 aa, Artificial Sequence
  Description of Artificial Sequence: Synthetic peptide
AHSTPW

SEQ ID NO: 950 - protein, 14 aa, Artificial Sequence
  Description of Artificial Sequence: Synthetic peptide
DDPYTDDDTFTKYW

SEQ ID NO: 951 - protein, 8 aa, Artificial Sequence
  Description of Artificial Sequence: Synthetic peptide
ISPHFARP

SEQ ID NO: 952 - protein, 18 aa, Artificial Sequence
  Description of Artificial Sequence: Synthetic peptide
ARDPFGDRAPHYNYHMDV

SEQ ID NO: 953 - protein, 7 aa, Artificial Sequence
  Description of Artificial Sequence: Synthetic peptide
QGLDSSH

SEQ ID NO: 954 - protein, 9 aa, Artificial Sequence
  Description of Artificial Sequence: Synthetic peptide
EDIFERTEL

SEQ ID NO: 955 - protein, 8 aa, Artificial Sequence
  Description of Artificial Sequence: Synthetic peptide
VKTVTGAV

SEQ ID NO: 956 - protein, 16 aa, Artificial Sequence
  Description of Artificial Sequence: Synthetic peptide
ARQKFYTGGQGWYFDL

SEQ ID NO: 957 - protein, 4 aa, Artificial Sequence
  Description of Artificial Sequence: Synthetic peptide
SYGH

SEQ ID NO: 958 - protein, 8 aa, Artificial Sequence
  Description of Artificial Sequence: Synthetic peptide
QFRFDGYG

SEQ ID NO: 959 - protein, 8 aa, Artificial Sequence
  Description of Artificial Sequence: Synthetic peptide
ISHDGIKK

SEQ ID NO: 960 - protein, 38 aa, Artificial Sequence
  Description of Artificial Sequence: Synthetic polypeptide
AKDLREDECEEWWSDYYDFGKQLPCAKSRGGLVGIADN

SEQ ID NO: 961 - protein, 8 aa, Artificial Sequence
  Description of Artificial Sequence: Synthetic peptide
TSNIGNNF

SEQ ID NO: 962 - protein, 10 aa, Artificial Sequence
  Description of Artificial Sequence: Synthetic peptide
GDSVSNDNYY

SEQ ID NO: 963 - protein, 7 aa, Artificial Sequence
  Description of Artificial Sequence: Synthetic peptide
IYYSGTT

SEQ ID NO: 964 - protein, 20 aa, Artificial Sequence
  Description of Artificial Sequence: Synthetic peptide
VRMPSHGFWSTSFSYWYFDL

SEQ ID NO: 965 - protein, 6 aa, Artificial Sequence
  Description of Artificial Sequence: Synthetic peptide
QSVTKY

SEQ ID NO: 966 - protein, 16 aa, Artificial Sequence
  Description of Artificial Sequence: Synthetic peptide
ADDDPYTDDDTFTKYW

SEQ ID NO: 967 - protein, 17 aa, Artificial Sequence
  Description of Artificial Sequence: Synthetic peptide
ISPHFARPIYSYKFRDR

SEQ ID NO: 968 - protein, 15 aa, Artificial Sequence
  Description of Artificial Sequence: Synthetic peptide
DPFGDRAPHYNYHMD

SEQ ID NO: 969 - protein, 9 aa, Artificial Sequence
  Description of Artificial Sequence: Synthetic peptide
ASQGLDSSH

SEQ ID NO: 970 - protein, 12 aa, Artificial Sequence
  Description of Artificial Sequence: Synthetic peptide
GTSNRARGTPDR

SEQ ID NO: 971 - protein, 11 aa, Artificial Sequence
  Description of Artificial Sequence: Synthetic peptide
TSEDIFERTEL

SEQ ID NO: 972 - protein, 17 aa, Artificial Sequence
  Description of Artificial Sequence: Synthetic peptide
VKTVTGAVNFGSPDFRQ

SEQ ID NO: 973 - protein, 13 aa, Artificial Sequence
  Description of Artificial Sequence: Synthetic peptide
QKFYTGGQGWYFD

SEQ ID NO: 974 - protein, 6 aa, Artificial Sequence
  Description of Artificial Sequence: Synthetic peptide
AASYGH

SEQ ID NO: 975 - protein, 12 aa, Artificial Sequence
  Description of Artificial Sequence: Synthetic peptide
ATSKRASGIPDR

SEQ ID NO: 976 - protein, 10 aa, Artificial Sequence
  Description of Artificial Sequence: Synthetic peptide
ASQFRFDGYG

SEQ ID NO: 977 - protein, 17 aa, Artificial Sequence
  Description of Artificial Sequence: Synthetic peptide
ISHDGIKKYHAEKVWGR

SEQ ID NO: 978 - protein, 35 aa, Artificial Sequence
  Description of Artificial Sequence: Synthetic polypeptide
DLREDECEEWWSDYYDFGKQLPCAKSRGGLVGIAD

SEQ ID NO: 979 - protein, 12 aa, Artificial Sequence
  Description of Artificial Sequence: Synthetic peptide
ETDKRPSGIPDR

SEQ ID NO: 980 - protein, 12 aa, Artificial Sequence
  Description of Artificial Sequence: Synthetic peptide
VSGDSVSNDNYY

SEQ ID NO: 981 - protein, 16 aa, Artificial Sequence
  Description of Artificial Sequence: Synthetic peptide
IYYSGTTYYNPSLRNR

SEQ ID NO: 982 - protein, 17 aa, Artificial Sequence
  Description of Artificial Sequence: Synthetic peptide
MPSHGFWSTSFSYWYFD

SEQ ID NO: 983 - protein, 8 aa, Artificial Sequence
  Description of Artificial Sequence: Synthetic peptide
ASQSVTKY

SEQ ID NO: 984 - protein, 12 aa, Artificial Sequence
  Description of Artificial Sequence: Synthetic peptide
GTYTLLSGVSPR

SEQ ID NO: 985 - protein, 131 aa, Artificial Sequence
  Description of Artificial Sequence: Synthetic polypeptide
QGRLFQSGAEVKRPGASVRISCRADDDPYTDDDTFTKYWTHWIRQAPGQRPEWLGVISPHFARPIYSYKFRDRLTLTRDSSLTAVYLELKGLQPDDSGIYFCARDPFGDRAPHYNYHMDVWGGGTAVIVSS

SEQ ID NO: 986 - protein, 112 aa, Artificial Sequence
  Description of Artificial Sequence: Synthetic polypeptide
EVVLTQSPAILSVSPGDRVILSCRASQGLDSSHLAWYRFKRGQIPTLVIFGTSNRARGTPDRFSGSGSGADFTLTISRVEPEDFATYYCQRYGGTPITFGGGTTLDKKRTVA

SEQ ID NO: 987 - protein, 125 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCARQKFYTGGQGWYFDLWGRGTLIVVSS

SEQ ID NO: 988 - protein, 105 aa, Artificial Sequence
  Description of Artificial Sequence: Synthetic polypeptide
EIVLTQSPGTLSLSPGETASLSCTAASYGHMTWYQKKPGQPPKLLIFATSKRASGIPDRFSGSQFGKQYTLTITRMEPEDFARYYCQQLEFFGQGTRLEIRRTVA

SEQ ID NO: 989 - protein, 145 aa, Artificial Sequence
  Description of Artificial Sequence: Synthetic polypeptide
QVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSS

SEQ ID NO: 990 - protein, 111 aa, Artificial Sequence
  Description of Artificial Sequence: Synthetic polypeptide
QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVL

SEQ ID NO: 991 - protein, 128 aa, Artificial Sequence
  Description of Artificial Sequence: Synthetic polypeptide
EVQLVESGPGLVQPWGTLSLTCRVSGDSVSNDNYYWAWIRQTPGRELQVIGTIYYSGTTYYNPSLRNRVTISLDKSVNVVSLRLGSVSAADTAQYYCVRMPSHGFWSTSFSYWYFDLWGRGHFVAVSW

SEQ ID NO: 992 - protein, 111 aa, Artificial Sequence
  Description of Artificial Sequence: Synthetic polypeptide
DIQMTQSPSSLSASVGDKVTITCRASQSVTKYLNWYQFKTGQAPRILIYGTYTLLSGVSPRFSGAGSGSLYTLTITNIQPEDFATYYCQQAHSTPWTFGQGTHVAANRTVA

SEQ ID NO: 993 - protein, 15 aa, Homo sapiens
EPKSCDKTHTCPPCP

SEQ ID NO: 994 - protein, 20 aa, Homo sapiens
EPKSCDKTHTCPPCPAPELL

SEQ ID NO: 995 - DNA, 984 bp, Artificial Sequence
  Description of Artificial Sequence: Synthetic polynucleotide
aagaaagtggtgtacggcaaaaagggcgacaccgtggaactgacctgtaccgccagccagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggaggatctgacaagacccacacctgtcctccatgtcctgctccagaagctgctggcggcccttctgtgttcctgtttcctccaaagcctaaggacaccctgtacatcacccgcgagcctgaagtgacctgtgtggtggtggatgtgtcccacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgcctcgtgaagggcttctacccttccgatatcgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggcaaa

SEQ ID NO: 996 - DNA, 1365 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagagcagattcaccatctctcgggacgactccaagaactccctgtacctggagatgaacagcctgcggaccgaggataccgccgtgtactattgtgtgcggcacggcaacttcggccactcctatgtgtcttggtttgcctactggggccagggcacactggtcacagtttcttccgcctctacaaagggccctagtgtgttccctctggctcccagcagcaagtctacatctggcggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccggtacacccagaagtccctgtctctgagccccggcaaa

SEQ ID NO: 997 - DNA, 645 bp, Artificial Sequence
  Description of Artificial Sequence: Synthetic polynucleotide
caagctgttgtgacacaagagcccagcctgacagtgtctcctggcggaacagtgacactgacctgtggatcttctacaggcgccgtgacaaccggccactatgctaattgggtgcagcagaaacccggacaggcccctagaggactgatcggcggaacatctaatagagcccctggcgtgccagccagattttctggatctctgctcggaggcaaggccgctctgacaatttctggcgcccagccagaggatgaggccgagtattattgtgccctgtggtacagcaacagatgggtgttcggcggaggcaccaaactgacagtgctgggacaacctaaggctgcccctagcgtgacactgtttcctccaagctctgaggaactccaggccaacaaggccacactcgtgtgcctgatcagcgatttttaccctggcgctgtgacagtggcctggaaggctgatagctctcctgtgaaagccggcgtggaaaccaccacacctagcaagcagagcaacaacaaatacgccgccagcagctacctgagcctgacacctgagcagtggaagtcccacagatcctacagctgccaagtgacccacgagggcagcaccgtggaaaaaacagtggcccctaccgagtgcagc

SEQ ID NO: 998 - DNA, 984 bp, Artificial Sequence
  Description of Artificial Sequence: Synthetic polynucleotide
aaaaaggtggtgtacggcaagaagggcgacaccgtcgagctgacctgtaccgcctctcagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggcggctctgataagacccatacctgtcctccatgtcctgctccagaagctgctggcggcccttccgtgtttctgttccctccaaagcctaaggacaccctgtacatcacccgcgagcctgaagtgacctgcgtggtggtggatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtcactgtggtgcctggtcaagggcttctacccctctgatatcgccgtggaatgggagagcaatggccagcctgagaacaactacaagaccacacctcctgtgctggacagcgacggctcattcttcctgtacagcaagctgacagtggacaagtccagatggcagcagggcaacgtgttctcctgctccgtgatgcacgaggccctgcacaatcactacacccagaagtccctgtctctgtcccctggcaaa

SEQ ID NO: 999 - DNA, 1365 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgctatgaactgggtccgacaggcccctggcaaaggactggaatgggtcggacggatccggtccaagtacaacaactacgccacctactacgccgactccgtgaagtcccggttcaccatctctcgggacgactccaagaactccctgtacctggaaatgaacagcctgcggaccgaggacaccgccgtgtattattgtgtgcggcacggcaacttcggccactcctatgtgtcttggtttgcctactggggccagggcacactggtcacagtttcttccgcctccaccaagggacccagcgttttccctctggctccatcctccaagtctacctctggcggaacagctgctctgggctgcctggtcaaggactactttcctgagcctgtgaccgtgtcctggaactctggcgctctgacatctggcgtgcacacctttccagctgtgctgcagtcctccggcctgtactctctgtcctctgtcgtgaccgtgccttccagctctctgggaacccagacctacatctgcaatgtgaaccacaagccttccaacaccaaggtggacaagaaggtggaacccaagtcctgcgacaagacccacacctgtcctccatgtcctgctccagaagctgctggcggcccttccgtgtttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtcctgtgccgtgaagggcttctacccttccgatatcgccgtggaatgggagagcaatggccagcctgagaacaactacaagacaacccctcctgtgctggactccgacggctcattcttcctggtgtccaagctgacagtggacaagtctagatggcagcagggcaacgtgttctcctgctccgtgatgcacgaggccctgcacaacagatacacccagaagtccctgtctctgagccccggaaaa

SEQ ID NO: 1000 - DNA, 645 bp, Artificial Sequence
  Description of Artificial Sequence: Synthetic polynucleotide
caggccgtggtcacccaagagcctagcctgacagtttctcctggcggcaccgtgacactgacctgtggatcttctaccggcgctgtgaccaccggccactacgctaattgggtgcagcagaagcctggacaggctcccagaggactgatcggcggcacctctaatagagcacctggcgtgccagccagattctccggatctctgcttggcggaaaggccgctctgacaatctctggtgctcagcctgaggacgaggccgagtactattgtgccctgtggtactccaacagatgggtgttcggcggaggcaccaagctgacagttctgggacagcctaaggctgccccttccgtgactctgttccctccatcctctgaggaactgcaggccaacaaggctaccctcgtgtgcctgatctccgacttttaccctggcgccgtgaccgtggcttggaaggctgatagttctcctgtgaaggccggcgtggaaaccaccacacctagcaagcagtccaacaacaaatacgccgcctcctcctacctgtctctgacccctgaacagtggaagtcccaccggtcctacagctgccaagtgacccatgagggctccaccgtggaaaagacagtggcccctaccgagtgctct

SEQ ID NO: 1001 - DNA, 984 bp, Artificial Sequence
  Description of Artificial Sequence: Synthetic polynucleotide
aagaaagtggtgtacggcaaaaagggcgacaccgtggaactgacctgtaccgccagccagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggaggatctgacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccggtacacccagaagtccctgtctctgagccccggcaaa

SEQ ID NO: 1002 - DNA, 1365 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccgctagcaccaagggcccctccgtgtttccactggctcctagcagcaagagcacaagcggaggaacagccgctctgggctgtctggtcaaggactactttcccgagcctgtgaccgtgtcctggaattctggcgctctgacaagcggcgtgcacacctttccagctgtgctgcaaagcagcggcctgtactctctgagcagcgtggtcacagtgccaagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttctgtgttcctgtttcctccaaagcctaaggacaccctgtacatcacccgcgagcctgaagtgacctgtgtggtggtggatgtgtcccacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgcctcgtgaagggcttctacccttccgatatcgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggcaaa

SEQ ID NO: 1003 - DNA, 585 bp, Artificial Sequence
  Description of Artificial Sequence: Synthetic polynucleotide
caagctgttgtgacacaagagcccagcctgacagtgtctcctggcggaacagtgacactgacctgtggatcttctacaggcgccgtgacaaccggccactatgctaattgggtgcagcagaaacccggacaggcccctagaggactgatcggcggaacatctaatagagcccctggcgtgccagccagattttctgccgagtattattgtgccctgtggtacagcaacagatgggtgttcggcggaggcaccaaactgacagtgctgggacaacctaaggctgcccctagcgtgacactgtttcctccaagctctgaggaactccaggccaacaaggccacactcgtgtgcctgatcagcgatttttaccctggcgctgtgacagtggcctggaaggctgatagctctcctgtgaaagccggcgtggaaaccaccacacctagcaagcagagcaacaacaaatacgccgccagcagctacctgagcctgacacctgagcagtggaagtcccacagatcctacagctgccaagtgacccacgagggcagcaccgtggaaaaaacagtggcccctaccgagtgcagc

SEQ ID NO: 1004 - DNA, 984 bp, Artificial Sequence
  Description of Artificial Sequence: Synthetic polynucleotide
aaaaaggtggtgtacggcaagaagggcgacaccgtcgagctgacctgtaccgcctctcagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggcggctctgataagacccatacctgtcctccatgtcctgctccagaagctgctggcggcccttccgtgtttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtcctgtgccgtgaagggcttctacccttccgatatcgccgtggaatgggagagcaatggccagcctgagaacaactacaagaccacacctcctgtgctggacagcgacggctcattcttcctggtgtctaagctgacagtggacaagtccagatggcagcagggcaacgtgttctcctgctccgtgatgcacgaggccctgcacaacagatacacccagaagtccctgagcctgtctcctggcaaa

SEQ ID NO: 1005 - DNA, 1311 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgctatgaactgggtccgacaggcccctggcaaaggactggaatgggtcggacggatccggtccaagtacaacaactacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccgcctccaccaagggacccagcgttttccctctggctccatcctccaagtctacctctggcggaacatggaactctggcgctctgacatctggcgtgcacacctttccagctgtgctgcagtcctccggcctgtactctctgtcctctgtcgtgaccgtgccttccagctctctgggaacccagacctacatctgcaatgtgaaccacaagccttccaacaccaaggtggacaagaaggtggaacccaagtcctgcgacaagacccacacctgtcctccatgtcctgctccagaagctgctggcggcccttccgtgtttctgttccctccaaagcctaaggacaccctgtacatcacccgcgagcctgaagtgacctgcgtggtggtggatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtggtgcctggttaagggcttctacccctccgatatcgccgtggaatgggagtctaatggccagcctgagaacaactacaagacaacccctcctgtgctggactccgacggctcattcttcctgtactccaagctgacagtggacaagtccagatggcagcagggcaacgtgttctcctgctccgtgatgcacgaggccctgcacaatcactacacccagaagtccctgtctctgagccctggcaag

SEQ ID NO: 1006 - DNA, 984 bp, Artificial Sequence
  Description of Artificial Sequence: Synthetic polynucleotide
aagaaagtggtgtacggcaaaaagggcgacaccgtggaactgacctgtaccgccagccagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggaggatctgacaagacccacacctgtcctccatgtcctgctccagaagctgctggcggcccttccgtgtttctgttccctccaaagcctaaggacaccctgtacatcacccgcgagcctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccactacacccagaagtccctgtctctgagccccggcaaa

SEQ ID NO: 1007 - DNA, 984 bp, Artificial Sequence
  Description of Artificial Sequence: Synthetic polynucleotide
aaaaaggtggtgtacggcaagaagggcgacaccgtcgagctgacctgtaccgcctctcagaagaagaacatccagttccactggaagaactccaaccagatcaagatcctgggcaaccagggcagcttcctgaccaagggaccttccaagctgaacgacagagtggactccagacggtccctgtgggaccagggcaactttccactgatcatcaagaacctgaagcctgaggactccgacacctacatctgcgaggtggaagatcagaaagaagaggtgcagctggtcgtcgtcggcggctctgataagacccatacctgtcctccatgtcctgctccagaagctgctggcggcccttccgtgtttctgttccctccaaagcctaaggacaccctgtacatcacccgcgagcctgaagtgacctgcgtggtggtggatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtcctgtgccgtgaagggcttctacccttccgatatcgccgtggaatgggagagcaatggccagcctgagaacaactacaagaccacacctcctgtgctggacagcgacggctcattcttcctggtgtctaagctgacagtggacaagtccagatggcagcagggcaacgtgttctcctgctccgtgatgcacgaggccctgcacaatcactacacccagaagtccctgagcctgtctcctggcaaa

SEQ ID NO: 1008 - DNA, 1365 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgctatgaactgggtccgacaggcccctggcaaaggactggaatgggtcggacggatccggtccaagtacaacaactacgccgcctactacgccgactccgtgaagtccagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccgcctccaccaagggacccagcgttttccctctggctccatcctccaagtctacctctggcggaacagctgctctgggctgcctggtcaaggactactttcctgagcctgtgaccgtgtcctggaactctggcgctctgacatctggcgtgcacacctttccagctgtgctgcagtcctccggcctgtactctctgtcctctgtcgtgaccgtgccttccagctctctgggaacccagacctacatctgcaatgtgaaccacaagccttccaacaccaaggtggacaagaaggtggaacccaagtcctgcgacaagacccacacctgtcctccatgtcctgctccagaagctgctggcggcccttccgtgtttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtcctgtgccgtgaagggcttctacccttccgatatcgccgtggaatgggagagcaatggccagcctgagaacaactacaagacaacccctcctgtgctggactccgacggctcattcttcctggtgtccaagctgacagtggacaagtccaggtggcagcagggcaacgtgttctcctgctctgtgatgcacgaggccctgcacaaccggtacacccagaagtctctgtctctgagccctggcaag

SEQ ID NO: 1009 - DNA, 1365 bp, Artificial Sequence
  Description of Artificial Sequence: Synthetic polynucleotide
gaggtgcagctggtggaatctggcggaggattggttcagcctggcggctctctgtctctgtcttgtgccgcttctggcttcaccttcaacacctacgctatgaactgggtccgacaggcccctggcaaaggactggaatgggtcggacggatccggtccaagtacaacaactacgccacctactacgccgactccgtgaagtcccggttcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccgcctccaccaagggacccagcgttttccctctggctccatcctccaagtctacctctggcggaacagctgctctgggctgcctggtcaaggactactttcctgagcctgtgaccgtgtcctggaactctggcgctctgacatctggcgtgcacacctttccagctgtgctgcagtcctccggcctgtacagtctgtcctctgtcgtgaccgtgccttccagctctctgggaacccagacctacatctgcaatgtgaaccacaagccttccaacaccaaggtggacaagaaggtggaacccaagtcctgcgacaagacccacacctgtcctccatgtcctgctccagaagctgctggcggcccttccgtgtttctgttccctccaaagcctaaggacaccctgatgatctctcggacccctgaagtgacctgcgtggtggtggatgtgtctcacgaggatcccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtcctgcgccgtgaagggcttctacccttctgatatcgccgtggaatgggagagcaacggccagcctgagaacaactacaagacaacccctcctgtgctggactccgacggctcattcttcctggtgtccaagctgacagtggacaagtctagatggcagcagggcaacgtgttctcctgctccgtgatgcacgaggccctgcacaacagatacacccagaagtccctgtctctgagccccggaaaa

SEQ ID NO: 1010 - DNA, 1458 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccggcggaggtggaagcggaggcggaggtagtggcggtggtggttcaggtggtggtggatctcaggctgtggttacccaggagcctagcctgacagtttctcctggcggcaccgtgacactgacctgtggatcttctaccggcgctgtgaccaccggccattacgctaattgggtgcagcagaagcctggacaggccccaagaggactgatcggcggcacatctaacagagcccctggcgtcccagccagattctctggatctctgcttggcggcaaggccgctctgacaatttctggtgctcagcctgaggacgaggccgagtactactgtgccctgtggtactccaacagatgggtgttcggcggaggcaccaagctgacagtgttggagcccaaatcttcagacaagacccacacctgtcctccatgtcctgctccagaagctgctggcggcccttctgtgttcctgtttcctccaaagcctaaggacaccctgtacatcacccgcgagcctgaagtgacctgtgtggtggtggatgtgtcccacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgcctcgtgaagggcttctacccttccgatatcgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggcaaa

SEQ ID NO: 1011 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgcctctacaaagggccctagtgtgttccctctggctcccagcagcaagtctacatctggcggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttccgtgtttctgttccctccaaagcctaaggacaccctgtacatcacccgcgagcctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccactacacccagaagtccctgtctctgagccccggcaaa

SEQ ID NO: 1012 - DNA, 618 bp, Artificial Sequence
  Description of Artificial Sequence: Synthetic polynucleotide
gatattcagatgacacagagccccagtagcctgagcgccagcgtgggcgacaccgcaaccatcacctgtcaggccaacggctatctgaactggtatcaacagaggaggggcaaggcccccaagctcctgatatacgacggcagcaagctggagaggggcgttcccagccgcttcagcggcaggaggtggggccaggagtacaaccttacaatcaacaacctgcagcccgaggacatcgccacctatttctgccaagtttacgagttcgtggtgcccggcaccaggctggacctgaagcggaccgtggccgcccccagcgtgttcatcttccctcccagcgacgagcagctgaagtctggcaccgccagcgtggtgtgcctgctgaacaacttctacccccgcgaggccaaggtgcagtggaaggtggacaacgccctgcagagcggcaacagccaggagagcgtgaccgagcaggactccaaggacagcacctacagcctgagcagcaccctgaccctgagcaaggccgactacgagaagcacaaggtgtacgcctgcgaggtgacccaccagggactgtctagccccgtgaccaagagcttcaaccggggcgagtgc

SEQ ID NO: 1013 - DNA, 1458 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgctatgaactgggtccgacaggcccctggcaaaggactggaatgggtcggacggatccggtccaagtacaacaactacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttctagcggcggaggtggaagcggaggcggaggtagtggtggtggcggatctggtggcggtggatctcaggctgtggtcacccaagagcctagcctgacagtttctcctggcggcaccgtgacactgacctgtggatcttctaccggcgctgtgaccaccggccactacgctaattgggtgcagcagaagcctggacaggctcccagaggactgatcggcggcacctctaatagagcacctggcgtgccagccagattctctggatctctgctcggcggaaaggccgctctgacaatttctggtgcccagcctgaggacgaggccgagtattattgtgccctgtggtactccaaccgctgggttttcggcggaggcaccaagctgacagtgctggaacctaagtcctccgacaagacccacacctgtcctccatgtcctgctccagaagctgctggcggcccttccgtgtttctgttccctccaaagcctaaggacaccctgtacatcacccgcgagcctgaagtgacctgcgtggtggtcgatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtggtgcctggtcaagggcttctacccttccgatatcgccgtggaatgggagagcaacggacagcccgagaacaactacaagacaacccctcctgtgctggactccgacggctcattcttcctgtacagcaagctgactgtggacaagtccagatggcagcagggcaacgtgttctcctgctccgtgatgcacgaggccctgcacaatcactacacccagaagtccctgtctctgagccctggcaag

SEQ ID NO: 1014 - DNA, 1359 bp, Artificial Sequence
  Description of Artificial Sequence: Synthetic polynucleotide
caggtgcagctgttgcaatctggcgccgctgtgacaaagcctggtgcctctgttagagtgtcctgcgaggcctccggctacaacatccgggactacttcatccactggtggcggcaggctccaggacagggattgcaatgggtcggatggatcaaccccaagaccggccagcctaacaaccctagacagttccagggcagagtgtctctgacccggcacgcctctttcgacttcgacaccttcagcttctacatggacctgaaggccctgcggagcgacgataccgccgtgtacttttgcgccagacagagatccgactactgggacttcgacgtgtggggctctggcacccaagtgacagtgtcctccgcttccaccaagggaccctctgtgtttcctctggctccctccagcaagtctacctctggtggaacagctgctctgggctgcctggtcaaggattacttccctgagcctgtgaccgtgtcctggaattctggcgctctgacatccggcgtgcacacctttccagctgtgctgcaatcctccggcctgtactctctgtcctccgtcgtgaccgtgccttctagctctctgggcacccagacctacatctgcaatgtgaaccacaagccttccaacaccaaggtggacaagaaggtggaacccaagtcctgcgacaagacccacacctgtcctccatgtcctgctccagaagctgctggcggcccatccgtgtttctgttccctccaaagcctaaggacaccctgtacatcacccgcgagcctgaagtgacctgcgtggtggtggatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggctctgcccgcctccatcgaaaagaccatctccaaggctaagggccagcctcgggaaccccaggtttacacattgcctccaagccgggaagagatgaccaagaaccaggtgtccctgagctgcgccgtgaagggcttctacccttctgatatcgccgtggaatgggagtccaacggccagccagagaacaactacaagacaacccctcctgtgctggactccgacggctcattcttcctggtgtctaagctgacagtggacaagtccagatggcagcagggcaacgtgttctcctgctccgtgatgcacgaggccctgcacaatcactacacccagaagtccctgtctctgtcccctggcaaa

SEQ ID NO: 1015 - DNA, 618 bp, Artificial Sequence
  Description of Artificial Sequence: Synthetic polynucleotide
gacatccagatgacccagtctccatcctctctgtccgcctctgtgggcgataccgctaccattacctgtcaggccaacggctacctgaactggtatcagcagcggagaggcaaggcccctaagctgctgatctacgacggctccaagctggaaagaggcgtgccctccagattctccggcagaagatggggccaagagtacaacctgaccatcaacaacctgcagcctgaggatatcgccacatacttttgccaggtgtacgagttcgtggtgcccggcacaagactggacctgaagagaacagtggccgctccttccgtgttcatcttcccaccttccgacgagcagctgaagtctggcacagcctctgtcgtgtgcctgctgaacaacttctaccctcgggaagccaaggtgcagtggaaggtggacaatgccctgcagtccggcaactcccaagagtctgtgaccgagcaggactccaaggacagcacctacagcctgtcctccacactgaccctgtccaaggccgactacgagaagcacaaggtgtacgcctgcgaagtgacccatcagggcctgtctagccctgtgaccaagtctttcaaccggggcgagtgt

SEQ ID NO: 1016 - DNA, 1458 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccggcggaggtggaagcggaggcggaggtagtggcggtggtggttcaggtggtggtggatctcaggctgtggttacccaggagcctagcctgacagtttctcctggcggcaccgtgacactgacctgtggatcttctaccggcgctgtgaccaccggccattacgctaattgggtgcagcagaagcctggacaggccccaagaggactgatcggcggcacatctaacagagcccctggcgtcccagccagattctctggatctctgcttggcggcaaggccgctctgacaatttctggtgctcagcctgaggacgaggccgagtactactgtgccctgtggtactccaacagatgggtgttcggcggaggcaccaagctgacagtgttggagcccaaatcttcagacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacaccctgcctccaagccgggaagagatgaccaagaaccaggtgtccctgtggtgcctggtcaagggcttctacccttccgatatcgccgtggaatgggagagcaatggccagcctgagaacaactacaagacaacccctcctgtgctggacagcgacggctcattcttcctgtacagcaagctgacagtggacaagagcagatggcagcagggcaacgtgttcagctgcagcgtgatgcacgaggccctgcacaaccactacacccagaagtccctgagcctgtctcctggcaaa

SEQ ID NO: 1017 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgcctctacaaagggccctagtgtgttccctctggctcccagcagcaagtctacatctggcggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccactacacccagaagtccctgtctctgagccccggcaaa

SEQ ID NO: 1018 - DNA, 1458 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagagcagattcaccatctctcgggacgactccaagaactccctgtacctggagatgaacagcctgcggaccgaggataccgccgtgtactattgtgtgcggcacggcaacttcggccactcctatgtgtcttggtttgcctactggggccagggcacactggtcacagtttcttccggcggaggtggaagcggaggcggaggtagtggcggtggtggttcaggtggtggtggatctcaggctgtggttacccaggagcctagcctgacagtttctcctggcggcaccgtgacactgacctgtggatcttctaccggcgctgtgaccaccggccattacgctaattgggtgcagcagaagcctggacaggccccaagaggactgatcggcggcacatctaacagagcccctggcgtcccagccagattctctggatctctgcttggcggcaaggccgctctgacaatttctggtgctcagcctgaggacgaggccgagtactactgtgccctgtggtactccaacagatgggtgttcggcggaggcaccaagctgacagtgttggagcccaaatcttcagacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccggtacacccagaagtccctgtctctgagccccggcaaa

SEQ ID NO: 1019 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgctagcaccaagggcccctccgtgtttccactggctcctagcagcaagagcacaagcggaggaacagccgctctgggctgtctggtcaaggactactttcccgagcctgtgaccgtgtcctggaattctggcgctctgacaagcggcgtgcacacctttccagctgtgctgcaaagcagcggcctgtactctctgagcagcgtggtcacagtgccaagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttctgtgttcctgtttcctccaaagcctaaggacaccctgtacatcacccgcgagcctgaagtgacctgtgtggtggtggatgtgtcccacgaggaccccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgcctcgtgaagggcttctacccttccgatatcgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggcaaa

SEQ ID NO: 1020 - DNA, 1359 bp, Artificial Sequence
  Description of Artificial Sequence: Synthetic polynucleotide
caggtgcagctgctgcagtctggcgccgctgtgacaaaaccaggcgcttctgtgcgggtgtcctgcgaggccagcggctacaacatccgggactacttcattcactggtggcgccaggcccctggacagggactgcagtgggtgggatggatcaaccccaagaccggccagcccaacaaccccagacagttccagggcagagtgtccctgaccagacacgccagcttcgacttcgacaccttcagcttctacatggacctgaaggccctgcggagcgacgataccgccgtgtacttctgcgccagacagagaagcgactactgggatttcgacgtgtggggcagcggcacccaagtgaccgtgtcatctgctagcaccaagggcccctccgtgtttccactggctcctagcagcaagagcacaagcggaggaacagccgctctgggctgtctggtcaaggactactttcccgagcctgtgaccgtgtcctggaattctggcgctctgacaagcggcgtgcacacctttccagctgtgctgcaaagcagcggcctgtactctctgagcagcgtggtcacagtgccaagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttctgtgttcctgtttcctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgcctcgtgaagggcttctacccttccgatatcgccgtggaatgggagagcaatggccagcctgagaacaactacaagacaacccctcctgtgctggacagcgacggctcattcttcctgtacagcaagctgacagtggacaagtccagatggcagcagggcaacgtgttcagctgcagcgtgatgcacgaggccctgcacaaccactacacccagaagtccctgagcctgtctcctggcaaa

SEQ ID NO: 1021 - DNA, 1458 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgccatgaactgggtccgacaggctcctggcaaaggcctggaatgggtcggacggatccggtccaagtacaacaattacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccggcggaggtggaagcggaggcggaggtagtggcggtggtggttcaggtggtggtggatctcaggctgtggttacccaggagcctagcctgacagtttctcctggcggcaccgtgacactgacctgtggatcttctaccggcgctgtgaccaccggccattacgctaattgggtgcagcagaagcctggacaggccccaagaggactgatcggcggcacatctaacagagcccctggcgtcccagccagattctctggatctctgcttggcggcaaggccgctctgacaatttctggtgctcagcctgaggacgaggccgagtactactgtgccctgtggtactccaacagatgggtgttcggcggaggcaccaagctgacagtgttggagcccaaatcttcagacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgagctgtgccgtgaagggcttctacccttccgatatcgccgtggaatgggagagcaatggccagcctgagaacaactacaagacaacccctcctgtgctggacagcgacggctcattcttcctggtgtccaagctgacagtggacaagtccagatggcagcagggcaacgtgttcagctgcagcgtgatgcacgaggccctgcacaaccggtacacccagaagtccctgtctctgagccccggcaaa

SEQ ID NO: 1022 - DNA, 1386 bp, Artificial Sequence
  Description of Artificial Sequence: Synthetic polynucleotide
cagatgcagctgcaggaatctggccctggcctcgtgaagccctccgagacactgtccctgacctgctctgtgtccggcgcctccatctccgactcctactggtcttggatccggcgatcccctggcaagggcctggaatggatcggctacgtgcacaagtccggcgacaccaactacaatcccagcctgaagtccagagtgcacctgtccctggacacctccaagaaccaggtgtccctgtctctgactggtgtcaccgctgctgactccggcaagtactactgcgccagaaccctgcacggcagacggatctacggcatcgtggccttcaacgagtggttcacctacttctacatggacgtgtggggcaccggcacccaagtgaccgtgtcctctgcctctacaaagggccctagtgtgttccctctggctcccagcagcaagtctacatctggcggaacagccgctctgggctgcctggtcaaggattactttcccgagcctgtgaccgtgtcctggaattctggcgctctgacaagcggcgtgcacacctttccagctgtgctgcaaagcagcggcctgtactctctgagcagcgtggtcacagtgcctagctctagcctgggcacccagacctacatctgcaatgtgaaccacaagcctagcaacaccaaggtggacaagaaggtggaacccaagagctgcgacaagacccacacctgtcctccatgtcctgctccagaagctgctggcggcccttccgtgtttctgttccctccaaagcctaaggacaccctgatgatcagcagaacccctgaagtgacctgcgtggtggtggatgtgtcccacgaggatcccgaagtgaagttcaattggtacgtggacggcgtggaagtgcacaacgccaagaccaagcctagagaggaacagtacaacagcacctacagagtggtgtccgtgctgaccgtgctgcaccaggattggctgaacggcaaagagtacaagtgcaaggtgtccaacaaggccctgcctgccagcatcgagaaaaccatcagcaaggccaagggccagcctagggaaccccaggtttacacactgcctccaagccgggaagagatgaccaagaaccaggtgtccctgtggtgtctggtgaagggcttctacccttccgatatcgccgtggaatgggagagcaatggccagcctgagaacaactacaagacaacccctcctgtgctggacagcgacggctcattcttcctgtactccaagctgacagtggacaagtccagatggcagcagggcaacgtgttcagctgcagcgtgatgcacgaggccctgcacaaccactacacccagaagtccctgtctctgagccccggcaaa

SEQ ID NO: 1023 - DNA, 633 bp, Artificial Sequence
  Description of Artificial Sequence: Synthetic polynucleotide
agcgacatcagcgtggccccaggcgagaccgccaggatcagctgcggcgagaagagcctgggcagcagggccgtgcaatggtatcagcacagggcaggccaggcccccagcctgatcatctacaacaaccaggacaggcccagcggcatccccgagaggttcagtggcagccccgacttcaggcccggtaccacagccaccctgaccatcacctcagtggaggccggtgacgaggccgactactactgccatatctgggacagcagagttcccaccaagtgggtctttggaggcggaaccaccttgaccgtgctgggacagcctaaggccgctccttccgtgaccctgttccctccatcctccgaggaactgcaggccaacaaggccaccctcgtgtgcctgatctccgacttctaccctggcgccgtgaccgtggcctggaaggctgatagctctcctgtgaaggccggcgtggaaaccaccaccccttccaagcagtccaacaacaaatacgccgcctcctcctacctgtccctgacccctgagcagtggaagtcccaccggtcctacagctgccaagtgacccacgagggctccaccgtggaaaagaccgtggctcctaccgagtgctcc

SEQ ID NO: 1024 - DNA, 1458 bp, Artificial Sequence; identical to SEQ ID NO: 1018
  Description of Artificial Sequence: Synthetic polynucleotide

SEQ ID NO: 1025 - DNA, 1386 bp, Artificial Sequence; identical to SEQ ID NO: 1022
  Description of Artificial Sequence: Synthetic polynucleotide

SEQ ID NO: 1026 - protein, 17 aa, Unknown
  Description of Unknown: serum albumin sequence
KWVTFISLLFLFSSAYS

SEQ ID NO: 1027 - protein, 20 aa, Unknown
  Description of Unknown: IL-2 sequence
MYRMQLLSCIALSLALVTNS

SEQ ID NO: 1028 - protein, 21 aa, Unknown
  Description of Unknown: SPOCK1 sequence
MPAIAVLAAAAAAWCFLQVES

SEQ ID NO: 1029 - protein, 22 aa, Unknown
  Description of Unknown: SPOCK2 sequence
MRAPGCGRLVLPLLLLAAAALA

SEQ ID NO: 1030 - protein, 17 aa, Unknown
  Description of Unknown: Ig Kappa sequence
METDTLLLWVLLLWVPG

SEQ ID NO: 1031 - protein, 18 aa, Unknown
  Description of Unknown: CSF2, GM-CSF sequence
MWLQSLLLLGTVACSISV

SEQ ID NO: 1032 - protein, 23 aa, Unknown
  Description of Unknown: PLAT, t-PA sequence
MDAMKRGLCCVLLLCGAVFVSAR

SEQ ID NO: 1033 - protein, 16 aa, Unknown
  Description of Unknown: CD74 sequence
MHRRRSRSCREDQKPV

SEQ ID NO: 1034 - protein, 31 aa, Unknown
  Description of Unknown: beta-catenin sequence
MRKAAVSHWQQQSYLDSGIHSGATTTAPSLS

SEQ ID NO: 1035 - protein, 107 aa, Unknown
  Description of Unknown: CCL7, MCP-3 sequence
MNPSAAVIFCLILLGLSGTQGILDMAQPVGINTSTTCCYRFINKKIPKQRLESYRRTTSSHCPREAVIFKTKLDKEICADPTQKWVQDFMKHLDKKTQTPKLASAGA

SEQ ID NO: 1036 - protein, 76 aa, Unknown [sequence omitted]

SEQ ID NO: 1037 - protein, 17 aa, Unknown
  Description of Unknown: calreticulin sequence
MLLSVPLLLGLLGLAVA

SEQ ID NO: 1038 - protein, 16 aa, Vesicular stomatitis virus G
MKCLLYLAFLFIGVNC

SEQ ID NO: 1039 - protein, 21 aa, Unknown
  Description of Unknown: CXCL10, IP-10 sequence
MNQTAILICCLIFLTLSGIQG

SEQ ID NO: 1040 - protein, 4 aa, Artificial Sequence
  Description of Artificial Sequence: Synthetic peptide
FDFD

SEQ ID NO: 1041 - protein, 8 aa, Artificial Sequence
  Description of Artificial Sequence: Synthetic 8xHis tag
HHHHHHHH

SEQ ID NO: 1042 - protein, 4 aa, Artificial Sequence
  Description of Artificial Sequence: Synthetic peptide
WDFD

SEQ ID NO: 1043 - protein, 486 aa, Artificial Sequence; identical to SEQ ID NO: 779
  Description of Artificial Sequence: Synthetic polypeptide

SEQ ID NO: 1044 - protein, 125 aa, Artificial Sequence; identical to SEQ ID NO: 713
  Description of Artificial Sequence: Synthetic polypeptide

SEQ ID NO: 1045 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 1046 - protein, 125 aa, Artificial Sequence
  Description of Artificial Sequence: Synthetic polypeptide
EVKLVESGGGLVQPGGSLRLSCAASGFTFNTYALNWVRQAPGKGLEWVARIRSKYNNYATYYADSVKDRFTISRDDSKSSLYLQMNNLKTEDTAVYYCVRHGNFGNSYVSWFAYWGQGTLVTVSS

SEQ ID NO: 1047 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYAASVKGRFTISRDDSKNSLYLQMNSLKTEDTAVYYCARHGNFGNSYVSWFAYWGQGTLVTVSS

SEQ ID NO: 1048 - protein, 125 aa, Artificial Sequence
  Description of Artificial Sequence: Synthetic polypeptide
EVQLLESGGGLVQPGGSLRLSCAASGFTFSTYAMNWVRQAPGKGLEWVSRIRSKYNNYATYYADSVKGRFTISRDDSKNTLYLQMNSLRAEDTAVYYCVRHGNFGNSYVSWFAYWGQGTLVTVSS

SEQ ID NO: 1049 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 1050 - protein, 109 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 1051 - protein, 109 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVL

SEQ ID NO: 1052 - protein, 109 aa, Artificial Sequence
  Description of Artificial Sequence: Synthetic polypeptide
QAVVTQEPSFSVSPGGTVTLTCRSSTGAVTTSNYANWVQQTPGQAFRGLIGGTNKRAPGVPARFSGSLIGDKAALTITGAQADDESIYFCALWYSNLWVFGGGTKLTVL

SEQ ID NO: 1053 - protein, 109 aa, Artificial Sequence
  Description of Artificial Sequence: Synthetic polypeptide
QTVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 1054 - protein, 109 aa, Artificial Sequence
  Description of Artificial Sequence: Synthetic polypeptide
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVL

SEQ ID NO: 1055 - protein, 109 aa, Artificial Sequence
  Description of Artificial Sequence: Synthetic polypeptide
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 1056 - protein, 109 aa, Artificial Sequence; identical to SEQ ID NO: 1050
  Description of Artificial Sequence: Synthetic polypeptide

SEQ ID NO: 1057 - protein, 109 aa, Homo sapiens
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSARWVFGGGTKLTVL

SEQ ID NO: 1058 - protein, 109 aa, Artificial Sequence; identical to SEQ ID NO: 723
  Description of Artificial Sequence: Synthetic polypeptide

SEQ ID NO: 1059 - protein, 109 aa, Artificial Sequence; identical to SEQ ID NO: 724
  Description of Artificial Sequence: Synthetic polypeptide

SEQ ID NO: 1060 - protein, 109 aa, Artificial Sequence; identical to SEQ ID NO: 57
  Description of Artificial Sequence: Synthetic polypeptide

SEQ ID NO: 1061 - protein, 109 aa, Artificial Sequence; identical to SEQ ID NO: 725
  Description of Artificial Sequence: Synthetic polypeptide

SEQ ID NO: 1062 - protein, 109 aa, Artificial Sequence; identical to SEQ ID NO: 726
  Description of Artificial Sequence: Synthetic polypeptide

SEQ ID NO: 1063 - protein, 109 aa, Artificial Sequence; identical to SEQ ID NO: 727
  Description of Artificial Sequence: Synthetic polypeptide

SEQ ID NO: 1064 - protein, 125 aa, Artificial Sequence; identical to SEQ ID NO: 713
  Description of Artificial Sequence: Synthetic polypeptide

SEQ ID NO: 1065 - protein, 116 aa, Homo sapiens
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARYYFDYWGQGTLVTVSS

SEQ ID NO: 1066 - protein, 125 aa, Artificial Sequence; identical to SEQ ID NO: 53
  Description of Artificial Sequence: Synthetic polypeptide

SEQ ID NO: 1067 - protein, 125 aa, Artificial Sequence; identical to SEQ ID NO: 715
  Description of Artificial Sequence: Synthetic polypeptide

SEQ ID NO: 1068 - protein, 125 aa, Artificial Sequence; identical to SEQ ID NO: 50
  Description of Artificial Sequence: Synthetic polypeptide

SEQ ID NO: 1069 - protein, 125 aa, Artificial Sequence; identical to SEQ ID NO: 716
  Description of Artificial Sequence: Synthetic polypeptide

SEQ ID NO: 1070 - protein, 125 aa, Artificial Sequence; identical to SEQ ID NO: 717
  Description of Artificial Sequence: Synthetic polypeptide

SEQ ID NO: 1071 - protein, 125 aa, Artificial Sequence; identical to SEQ ID NO: 718
  Description of Artificial Sequence: Synthetic polypeptide

SEQ ID NO: 1072 - protein, 125 aa, Artificial Sequence; identical to SEQ ID NO: 719
  Description of Artificial Sequence: Synthetic polypeptide

SEQ ID NO: 1073 - protein, 125 aa, Artificial Sequence; identical to SEQ ID NO: 720
  Description of Artificial Sequence: Synthetic polypeptide

SEQ ID NO: 1074 - protein, 125 aa, Artificial Sequence; identical to SEQ ID NO: 721
  Description of Artificial Sequence: Synthetic polypeptide

SEQ ID NO: 1075 - protein, 125 aa, Artificial Sequence; identical to SEQ ID NO: 722
  Description of Artificial Sequence: Synthetic polypeptide

SEQ ID NO: 1076 - protein, 109 aa, Artificial Sequence; identical to SEQ ID NO: 1050
  Description of Artificial Sequence: Synthetic polypeptide

SEQ ID NO: 1077 - protein, 109 aa, Homo sapiens; identical to SEQ ID NO: 1057

SEQ ID NO: 1078 - protein, 109 aa, Artificial Sequence; identical to SEQ ID NO: 731
  Description of Artificial Sequence: Synthetic polypeptide

SEQ ID NO: 1079 - protein, 109 aa, Artificial Sequence; identical to SEQ ID NO: 58
  Description of Artificial Sequence: Synthetic polypeptide

SEQ ID NO: 1080 - protein, 109 aa, Artificial Sequence; identical to SEQ ID NO: 732
  Description of Artificial Sequence: Synthetic polypeptide

SEQ ID NO: 1081 - protein, 109 aa, Artificial Sequence; identical to SEQ ID NO: 733
  Description of Artificial Sequence: Synthetic polypeptide

SEQ ID NO: 1082 - protein, 125 aa, Artificial Sequence; identical to SEQ ID NO: 713
  Description of Artificial Sequence: Synthetic polypeptide

SEQ ID NO: 1083 - protein, 116 aa, Homo sapiens; identical to SEQ ID NO: 1065

SEQ ID NO: 1084 - protein, 125 aa, Artificial Sequence; identical to SEQ ID NO: 50
  Description of Artificial Sequence: Synthetic polypeptide

SEQ ID NO: 1085 - protein, 125 aa, Artificial Sequence; identical to SEQ ID NO: 728
  Description of Artificial Sequence: Synthetic polypeptide

SEQ ID NO: 1086 - protein, 125 aa, Artificial Sequence; identical to SEQ ID NO: 729
  Description of Artificial Sequence: Synthetic polypeptide

SEQ ID NO: 1087 - protein, 125 aa, Artificial Sequence; identical to SEQ ID NO: 730
  Description of Artificial Sequence: Synthetic polypeptide

SEQ ID NO: 1088 - protein, 5 aa, Artificial Sequence
  Description of Artificial Sequence: Synthetic peptide
GGGGS

SEQ ID NO: 1089 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1090 - protein, 12 aa, Artificial Sequence
  Description of Artificial Sequence: Synthetic peptide
VSGDSTAGCDYF

SEQ ID NO: 1091 - protein, 8 aa, Artificial Sequence
  Description of Artificial Sequence: Synthetic peptide
ASQSVKNN

SEQ ID NO: 1092 - protein, 9 aa, Artificial Sequence
  Description of Artificial Sequence: Synthetic peptide
QRSDFWDFD

SEQ ID NO: 1093 - DNA, 1365 bp, Artificial Sequence
  Description of Artificial Sequence: Synthetic polynucleotide
gaggtgcagctggtggaatctggcggaggattggttcagcctggcggctctctgagactgtcttgtgccgcttctggcttcaccttcaacacctacgctatgaactgggtccgacaggcccctggcaaaggactggaatgggtcggacggatccggtccaagtacaacaactacgccacctactacgccgactccgtgaagggcagattcaccatctctcgggacgactccaagaactccctgtacctgcagatgaacagcctgcggaccgaggataccgccgtgtactattgtgtgcggcacggcaacttcggccactcctatgtgtcttggtttgcctactggggccagggcacactggtcacagtttcttccgcctccaccaagggacccagcgttttccctctggctccatcctccaagtctacctctggcggaacagctgctctgggctgcctggtcaaggactactttcctgagcctgtgaccgtgtcctggaactctggcgctctgacatctggcgtgcacacctttccagctgtgctgcagtcctccggcctgtactctctgtcctctgtcgtgaccgtgccttccagctctctgggaacccagacctacatctgcaatgtgaaccacaagccttccaacaccaaggtggacaagaaggtggaacccaagtcctgcgacaagacccacacctgtcctccatgtcctgctccagaagctgctggcggcccttccgtgtttctgttccctccaaagcctaaggacaccctgtacatcacccgcgagcctgaagtgacctgcgtggtggtggatgtgtctcacgaggaccccgaagtgaagttcaattggtacgtggacggcgtggaagtgcacaacgccaagaccaagcctagagaggaacagtacaactccacctacagagtggtgtccgtgctgaccgtgctgcaccaggattggctgaacggcaaagagtacaagtgcaaggtgtccaacaaggccctgcctgcctccatcgaaaagaccatctccaaggccaagggccagcctagggaaccccaggtttacaccctgccacctagccgggaagagatgaccaagaaccaggtgtccctgtggtgcctggttaagggcttctacccctccgatatcgccgtggaatgggagtctaatggccagcctgagaacaactacaagacaacccctcctgtgctggactccgacggctcattcttcctgtactccaagctgacagtggacaagtccagatggcagcagggcaacgtgttctcctgctccgtgatgcacgaggccctgcacaatcactacacccagaagtccctgtctctgagccctggcaag

What is claimed is:

1. A multi-specific antigen binding molecule that binds to human CD3 and an HIV antigen, wherein the antigen binding molecule comprises:
   (a) a first antigen binding domain that comprises a first heavy chain variable domain (VH) and a first light chain variable domain (VL), wherein the first antigen binding domain binds to CD3 and comprises a first VH-complementarity determining region (CDR) 1, a first VH-CDR2, a first VH-CDR3, a first VL-CDR1, a first VL-CDR2 and a first VL-CDR3 comprising the following amino acid sequences, respectively:
      (i) SEQ ID NOs: 1, 11, 8, 4, 9 and 10; or
      (ii) SEQ ID NOs: 1, 12, 8, 4, 9 and 10,
      wherein the first VH and the first VL comprise the amino acid sequences of SEQ ID NOs: 51 and 56, respectively, or comprise amino acid sequences that are at least 95%, at least 96%, at least 97%, at least 98%, or at least 99% identical to the amino acid sequences set forth, respectively: SEQ ID NOs: 51 and 56; and
   (b) the second antigen binding domain comprises one or more extracellular (EC) domains of CD4.

2. The multi-specific antigen binding molecule of claim 1, wherein the one or more EC domains of CD4 comprise an amino acid sequence as set forth below, or an amino acid sequence that is at least 93%, at least 94%, at least 95%, at least 96%, at least 97%, at least 98%, or at least 99% identical to a sequence selected from the group consisting of:

(i)
(SEQ ID NO: 746)
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVG;

(ii)
(SEQ ID NO: 747)
KKVVYGKKGDTVELTCTASQKKNIQFHWKNSNQIKILGNQGSFLTKGPSK

LNDRVDSRRSLWDQGNFPLIIKNLKPEDSDTYICEVEDQKEEVQLVVVGG

GGSGKKVVYGKKGDTVELTCTASQKKNIQFHWKNSNQIKILGNQGSFLTK

GPSKLNDRVDSRRSLWDQGNFPLIIKNLKPEDSDTYICEVEDQKEEVQLV

VVG;

(iii)
(SEQ ID NO: 748)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFG;
or (iv)
(SEQ ID NO: 749)
KKVVLGKKGDTVELTCTASQKKSIQFHWKNSNQIKILGNQGSFLTKGPSK

LNDRADSRRSLWDQGNFPLIIKNLKIEDSDTYICEVEDQKEEVQLLVFGG

GGSGKKVVLGKKGDTVELTCTASQKKSIQFHWKNSNQIKILGNQGSFLTK

GPSKLNDRADSRRSLWDQGNFPLIIKNLKIEDSDTYICEVEDQKEEVQLL

VFG.

3. The multi-specific antigen binding molecule of claim 2, wherein the EC domain of CD4 comprises an amino acid sequence of SEQ ID NO: 746 or an amino acid sequence that is at least 93%, at least 94%, at least 95%, at least 96%, at least 97%, at least 98%, or at least 99% identical to a sequence of SEQ ID NO: 746.

4. The multi-specific antigen binding molecule of claim 2, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively: SEQ ID NOs: 1, 11, 8, 4, 9 and 10; or SEQ ID NOs: 1, 12, 8, 4, 9 and 10; and the second antigen binding domain comprises one or more EC domains of CD4 comprising an amino acid sequence that comprises or is at least 93%, at least 94%, at least 95%, at least 96%, at least 97%, at least 98%, or at least 99%, identical to the EC domains of CD4 selected from the group consisting of SEQ ID NOs: 746-749.

5. The multi-specific antigen binding molecule of claim 4, wherein the first antigen binding domain comprises a first VH-CDR1, a first VH-CDR2, a first VH-CDR3, a first VL-CDR1, a first VL-CDR2 and a first VL-CDR3 comprising the following amino acid sequences, respectively: SEQ ID NOs: 1, 12, 8, 4, 9 and 10; and the second antigen binding domain comprises the EC domain of CD4 comprising an amino acid sequence of SEQ ID NO:746 or an amino acid sequence that is at least 93%, at least 94%, at least 95%, at least 96%, at least 97%, at least 98%, or at least 99%, identical to the EC domain of CD4 of SEQ ID NO: 746.

6. The multi-specific antigen binding molecule of claim 2, wherein the first antigen binding domain comprises a first VH and a first VL comprising the amino acid sequences set forth, respectively, or comprising amino acid sequences that are at least 95%, at least 96%, at least 97%, at least 98%, or at least 99% identical to the amino acid sequences set forth, respectively: SEQ ID NOs: 51 and 56; and the second antigen binding domain comprises the EC domain of CD4 comprising an amino acid sequence of SEQ ID NO:746 or an amino acid sequence that is at least 93%, at least 94%, at least 95%, at least 96%, at least 97%, at least 98%, or at least 99%, identical to the EC domain of CD4 of SEQ ID NO: 746.

7. The multi-specific antigen binding molecule of claim 1, comprising a heterodimeric human IgG1 or IgG4, comprising a first Fc region and a second Fc region.

8. The multi-specific antigen binding molecule of claim 1, comprising a heterodimeric human IgG1 or IgG4, comprising a first Fc region and a second Fc region, comprising the following amino acids at the indicated positions (EU numbering):
   (i) the first Fc region comprises an alanine at position 234 (L234A), an alanine at position 235 (L235A), a serine at position 331 (P331S) and a tryptophan at position 366 (T366W); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R);
   (ii) the first Fc region comprises an alanine at position 234 (L234A), an alanine at position 235 (L235A), a serine at position 331 (P331S) and a tryptophan at position 366 (T366W); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), an arginine at position 435 (H435R) and a phenylalanine at position 436 (Y436F);
   (iii) the first Fc region comprises an alanine at position 234 (L234A), an alanine at position 235 (L235A), a serine at position 331 (P331S), a serine at position 366 (T366S), an alanine at position 368 (L368A), and a valine at position 407 (Y407V); and the second Fc region comprises an alanine at position 234 (L234A), an alanine at position 235 (L235A), a serine at position 331 (P331S) and a tryptophan at position 366 (T366W);

(iv) the first Fc region comprises an alanine at position 234 (L234A), an alanine at position 235 (L235A), a serine at position 331 (P331S), a tryptophan at position 366 (T366W), a leucine at position 428 (M428L) and a serine at position 434 (N434S); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R); or (v) the first Fc region comprises an alanine at position 234 (L234A), an alanine at position 235 (L235A), a serine at position 331 (P331S), a tryptophan at position 366 (T366W), a tyrosine at position 252 (M252Y), a threonine at position 254 (S254T) and a glutamic acid at position 256 (T256E); and the second Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R).

9. The multi-specific antigen binding molecule of claim 1, comprising a heterodimeric human IgG1, comprising a first Fc region and a second Fc region, comprising the following amino acids at the indicated positions (EU numbering): the first Fc region comprises an alanine a position 234 (L234A), an alanine at position 235 (L235A), a serine at position 331 (P331S), a serine at position 366 (T366S), an alanine at position 368 (L368A), a valine at position 407 (Y407V), and an arginine at position 435 (H435R); and the second Fc region comprises an alanine at position 234 (L234A), an alanine at position 235 (L235A), a serine at position 331 (P331S), a tryptophan at position 366 (T366W), a tyrosine at position 252 (M252Y), a threonine at position 254 (S254T) and a glutamic acid at position 256 (T256E).

10. The multi-specific antigen binding molecule of claim 8, comprising a heterodimeric human IgG1, comprising a first Fc region and a second Fc region, comprising amino acid sequences of SEQ ID NOs.: 703 and 705, or that are at least 95%, at least 96%, at least 97%, at least 98%, or at least 99% identical to the amino acid sequences set forth, respectively: SEQ ID NOs.: 703 and 705.

11. The multi-specific antigen binding molecule of claim 1, wherein the multi-specific antigen binding molecule is a bispecific antigen binding molecule.

12. The multi-specific antigen binding molecule of claim 1, wherein the first antigen binding domain has reduced or insignificant or substantially no binding to Protein A, or does not detectably bind to Protein A.

13. The multi-specific antigen binding molecule of claim 1, wherein the first antigen binding domain binds to Protein A with a KD of greater than $10^{-6}$ M.

14. The multi-specific antigen binding molecule of claim 1, wherein the first antigen binding domain binds to CD3 with a KD of lower than 10 nM.

15. The multi-specific antigen binding molecule of claim 1, wherein the antigen binding molecule has a serum half-life in a human or cynomolgus monkey of at least 3 days.

16. The multi-specific antigen binding molecule of claim 1, wherein the first antigen binding domain binds to CD3 with a $K_D$ of lower than 7.0 nM, and the antigen binding molecule has a serum half-life in a human or cynomolgus monkey of at least at least 5 days.

17. A pharmaceutical composition comprising one or more of the multi-specific antigen binding molecules claimed in claim 1, and a pharmaceutically acceptable carrier.

18. A kit comprising one or more containers comprising one or more of the multi-specific antigen binding molecules claimed in claim 1.

19. The multi-specific antigen binding molecule of claim 1, wherein the first antigen binding domain comprises the first VH and the first VL comprising the amino acid sequences set forth, respectively, in SEQ ID NOs: 51 and 56.

20. The multi-specific antigen binding molecule of claim 2, wherein the EC domain of CD4 comprises an amino acid sequence of SEQ ID NO: 746.

21. The multi-specific antigen binding molecule of claim 2, wherein the first antigen binding domain comprises the first VH and the first VL comprising the amino acid sequences set forth, respectively, in SEQ ID NOs: 51 and 56; and the second antigen binding domain comprises the EC domain of CD4 comprising an amino acid sequence of SEQ ID NO: 746.

* * * * *